(12) United States Patent
Anthony et al.

(10) Patent No.: US 9,260,708 B2
(45) Date of Patent: *Feb. 16, 2016

(54) YEAST PRODUCTION HOST CELLS

(75) Inventors: Larry Cameron Anthony, Aston, PA (US); Mark J. Nelson, Newark, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 502 days.

This patent is subject to a terminal disclaimer.

(21) Appl. No.: 12/893,089

(22) Filed: Sep. 29, 2010

(65) Prior Publication Data

US 2011/0124060 A1 May 26, 2011

Related U.S. Application Data

(60) Provisional application No. 61/246,709, filed on Sep. 29, 2009.

(51) Int. Cl.
| | |
|---|---|
| C12N 1/14 | (2006.01) |
| C12P 7/16 | (2006.01) |
| C12Q 1/68 | (2006.01) |
| C12N 15/00 | (2006.01) |
| C12N 9/06 | (2006.01) |
| C12N 9/04 | (2006.01) |
| C12N 9/88 | (2006.01) |
| C12N 9/10 | (2006.01) |
| C07H 21/04 | (2006.01) |
| C12N 9/02 | (2006.01) |
| C12N 15/81 | (2006.01) |
| C12N 9/12 | (2006.01) |

(52) U.S. Cl.
CPC ............... *C12N 9/88* (2013.01); *C12N 9/0006* (2013.01); *C12N 9/0008* (2013.01); *C12N 9/1022* (2013.01); *C12N 9/1205* (2013.01); *C12N 15/81* (2013.01); *C12N 15/815* (2013.01); *C12P 7/16* (2013.01); *Y02E 50/10* (2013.01)

(58) Field of Classification Search
CPC .. C12N 9/0006; C12N 9/0008; C12N 9/1022; C12N 9/88; C12N 15/81; C12N 15/815; C12P 7/16
See application file for complete search history.

(56) References Cited

U.S. PATENT DOCUMENTS

| | | | |
|---|---|---|---|
| 4,683,202 | A | 7/1987 | Mullis et al. |
| 7,851,188 | B2 | 12/2010 | Donaldson et al. |
| 7,932,063 | B2 | 4/2011 | Dunson et al. |
| 7,993,889 | B1 | 8/2011 | Donaldson et al. |
| 2005/0059136 | A1 | 3/2005 | van Maris et al. |
| 2007/0031918 | A1 | 2/2007 | Dunson et al. |
| 2007/0031950 | A1 | 2/2007 | Winkler |
| 2007/0092957 | A1 | 4/2007 | Donaldson et al. |
| 2007/0259410 | A1 | 11/2007 | Donaldson et al. |
| 2007/0292927 | A1 | 12/2007 | Donaldson et al. |
| 2008/0182308 | A1 | 7/2008 | Donaldson et al. |
| 2008/0261230 | A1 | 10/2008 | Liao et al. |
| 2009/0155870 | A1 | 6/2009 | Donaldson et al. |
| 2009/0163376 | A1 | 6/2009 | Li et al. |
| 2009/0269823 | A1 | 10/2009 | Bramucci et al. |
| 2009/0305363 | A1 | 12/2009 | Anthony et al. |
| 2010/0081154 | A1 | 4/2010 | Flint et al. |
| 2010/0081179 | A1 | 4/2010 | Anthony et al. |
| 2010/0120105 | A1 | 5/2010 | Anthony et al. |
| 2010/0197519 | A1 | 8/2010 | Li et al. |
| 2011/0124060 | A1 | 5/2011 | Anthony et al. |
| 2011/0136192 | A1 | 6/2011 | Paul et al. |
| 2011/0244536 | A1 | 10/2011 | Nagarajan et al. |
| 2011/0269199 | A1 | 11/2011 | Satagopan et al. |
| 2012/0064561 | A1 | 3/2012 | Flint et al. |
| 2012/0156735 | A1 | 6/2012 | Dauner et al. |
| 2012/0237988 | A1 | 9/2012 | Anthony et al. |

FOREIGN PATENT DOCUMENTS

| | | |
|---|---|---|
| EP | 1728854 | 6/2006 |
| WO | 9826079 | 6/1998 |
| WO | 0061722 | 10/2000 |
| WO | 2004099425 | 11/2004 |
| WO | 2008/080124 | 7/2008 |
| WO | 2009046370 | 4/2009 |
| WO | 2009/086423 | 7/2009 |
| WO | 2009086423 | 7/2009 |

OTHER PUBLICATIONS van Maris et al. Directed evolution of pyruvate decarboxylase-negative *Saccharomyces cerevisiae*, yielding a C2-independent, glucose-tolerant, and pyruvate-hyperproducing yeast. Appl Environ Microbiol. Jan. 2004;70(1):159-66.*

Stewart et al. Biotechnology and Genetic Engineering Reviews, 14:67-143, 1997.*

Altschul et al., "Basic Local Alignment Search Tool", M. Mol. Biol., (1990) vol. 215, pp. 403-410.

Deshpande, "Ethanol Production from Cellulose by Coupled Saccharification/Fermentation using *Saccharomyces cerevisiae* and Cellulase Complex from Sclerotium rolfsii UV-8 Mutant*", Applied Biochemistry and Biotechnology, vol. 36 (1992) pp. 227-234.

Diderich, et al., "Physiological properties of *Saccharomyces cerevisiae* from which hexokinase II has been deleted", Applied and Environmental Microbiology, vol. 67, No. 4, Apr. 2001, pp. 1587-1593.

Elbing et al., "Role of hexose transport in control of glycolytic flux in *Saccharomyces cerevsiae*", Applied and Environmental Microbiology, vol. 70, No. 9, Sep. 2004, pp. 5323-5330.

(Continued)

Primary Examiner — Yong Pak

(57) ABSTRACT

Crabtree positive yeast cells that have endogenous expressed pyruvate decarboxylase genes inactivated and an engineered biosynthetic pathway utilizing pyruvate were found to have improved growth and product yield when glucose repression was reduced. These cells were able to grow in media containing a high glucose concentration.

7 Claims, 8 Drawing Sheets

(56) References Cited

OTHER PUBLICATIONS

Flick et al., "GRR1 of *Saccharomyces cerevisiae* is required for glucose repression and encodes a protein with leucine-rich repeats", Molecular and Cellular Biology, vol. 11, No. 10, Oct. 1991, pp. 5101-5112.

Gancedo, "Yeast carbon catabolite repression", Microbiology and Molecular Biology Reviews, vol. 62, No. 2, Jun. 1998, pp. 334-361.

Godon et al., "Branched-chain amino acid biosynthesis genes in *Lactococcus lactic* subsp. *lactis*", Journal of Bacteriology, Oct. 1992, vol. 174, No. 20, pp. 6580-6589.

Gollop, et al., "Physiological implications of the substrate specificites of acetohydroxy acid synthases from varied organisms", Jounral of Bacteriology, Jun. 1990, vol. 172, No. 6, pp. 3444-3449.

Guo et al., "Pervaporation study on the dehydration of aqueous butanol solutions: a comparison of flux vs. permeance, separation factor vs. selectivity", Journal of Membrane Science 245 (2004) pp. 199-210.

Henricsson et al., "Engineering of a novel *Saccharomyces cerevisiae* wine strain with a respiratory phenotype at high external glucose concentrations", Applied and Environmental Microbiology, vol. 71, No. 10, Oct. 2005, pp. 6185-6192.

Higgins et al., "Fast and sensitive multiple sequence alignments on a microcomputer", CABIOS Communications, vol. 5, No. 2 (1989) pp. 151-153.

Higgins et al., "CLUSTAL V: improved software for multiple sequence alignment", CABIOS, vol. 8, No. 2 (1992) pp. 189-191.

Holtzclaw et al., "Degradative acetolactate synthase of Bacillus subtilis: purification and properties", Journal of Bacteriology, Mar. 1975, vol. 121, No. 3, pp. 917-922.

Horton et al., "Engineering hybrid genes without the use of restriction enzymes: gene splicing by overlap extension", Gene, 77 (1989) pp. 61-68.

Ishida et al., "Efficient production of L-lactic acid by metabolically engineered *Saccharomyces cerevisiae* with a genome-integrated L-lactate dehydrogenase gene", Applied and Environmental Microbiology, vol. 71, No. 4, Apr. 2005, pp. 1964-1970.

Kim et al., "Metabolic engineering of the nonmevalonate isopentenyl diphosphate synthesis pathway in *Escherichia coli* enhances lycopene production", Biotechnology and Bioengineering, vol. 72, No. 4, Feb. 20, 2001, pp. 408-415.

Ma et al., "Plasmid construction by homologous recombination in yeast", Gene, 58 (1987) pp. 201-216.

Martin et al., "Engineering a mevalonate pathway in *Escherichia coli* for production of terpenoids", Nature Biotechnology, vol. 21, No. 7, Jul. 2003, pp. 796-802.

Mnaimneh et al., "Exploration of essential gene functions via titratable promoter alleles", Cell, vol. 118 (2004) pp. 31-44.

Nevoigt et al., "Reduced pyruvate decarboxylase and increased glycerol-3-phosphate dehydrogenase [NAD+] levels enhance glycerol production in *Saccharomyces cerevisiae*", Yeast, vol. 12 (1996) pp. 1331-1337.

Rossell et al., "Mixed and diverse metabolic and gene-expression regulation of the glycolytic and fermentative pathways in response to a HXK2 deletion of *Saccharomyces cerevisiae*", FEMS Yeast Research, vol. 8 (2008) pp. 155-164.

Tabor et al., "A bacteriophage T7 RNA polymerase/promoter system for controlled exclusive expression of specific genes", Proceedings of the National Academy of Sciences USA, vol. 82 (1985) pp. 1074-1078.

Wach et al., "New heterologous modules for classical or PCR-based gene disruptions in *Saccharomyces cerevisiae*", Yeast, vol. 10 (1994) pp. 1793-1808.

Walker et al., "Isothermal in vitro amplification of DNA by a restriction enzyme/DNA polymerase system", Proceedings of the National Academy of Sciences USA, vol. 89, Jan. 1992, pp. 392-396.

Ye et al., "Growth and glucose repression are controlled by glucose transport in *Saccharomyces cerevisiae* cells containing only one glucose transporter", Journal of Bacteriology, vol. 181, No. 15, Aug. 1999, pp. 4673-4675.

Zelle et al., "Malic Acid Production by *Saccharomyces cerevisiae*: Engineering of Pyruvate Carboxylation, Oxaloacetate Reduction, and Malate Export", Applied and Environmental Microbiology, vol. 74, No. 9, May 2008, pp. 2766-2777.

Methods in Enzymology, vol. 194, Guide to Yeast Genetics and Molecular and Cell Biology, Part A, 2004, Christine Guthrie and Gerald R. Fink (Eds.), Elsevier Academic Press, San Diego, CA.

Methods in Yeast Genetics, 2005, Cold Spring Harbor Laboratory Press, Cold Spring Harbor, NY.

W. R. Pearson, Comput. Methods Genome Res., [Proc. Int. Symp.] (1994), Meeting Date 1992, 111-20.

Sambrook, J., Fritsch, E. F. and Maniatis, T. Molecular Cloning: A Laboratory Manual, 2nd ed., Cold Spring Harbor Laboratory: Cold Spring Harbor, NY (1989).

Aden et al. Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.

International Search Report and Written Opinion in corresponding PCT/US2010/050737 mailed Nov. 15, 2010.

U.S. Appl. No. 61/246,717 now U.S. Appl. No. 12/893,065, filed Sep. 29, 2010.

U.S. Appl. No. 61/246,844 now U.S. Appl. No. 12/893,077, filed Sep. 29, 2010.

U.S. Appl. No. 61/290,636 now U.S. Appl. No. 12/980,597, filed Dec. 29, 2010.

U.S. Appl. No. 61/290,639 now U.S. Appl. No. 12/980,607, filed Dec. 29, 2010.

U.S. Appl. No. 61/305,333 now U.S. Appl. No. 13/029,558, filed Feb. 17, 2011.

U.S. Appl. No. 61/356,379, filed Jun. 18, 2010.

U.S. Appl. No. 61/380,563, filed Sep. 7, 2010.

van Maris et al., "Directed Evolution of Pyruvate Decarboxylase-Negative *Saccharomyces cerevisiae*, Yielding a C2-Independent, Glucose-Tolerant, and Pyruvate-Hyperproducing Yeast", Applied and Environmental Microbiology, Jan. 2004, vol. 70, No. 1, pp. 159-166.

Ahuatzi et al., "The glucose-regulated nuclear localization of hexokinase 2 in *Saccharomyces cerevisiae* is mig1-dependent", J. Biol. Chem. 279(14):14440-6 (2004).

Bianchi, M.M., et al., "The 'petite-negative' yeast Kluyveromyces lactis has a single gene expressing pyruvate decarboxylase activity," Mol. Microbiol. 19(1):27-36, Blackwell Scientific Publications, England (1996).

Bisson et al., "Involvement of kinases in glucose and fructose uptake by *Saccharomyces cerevisiae*", PNAS 80:17301734 (1983).

Bonini et al., "Uncoupling of the glucose growth defect and deregulation of glycolysis in *Saccharomyces cerevisiae* tps1 mutants expressing trehalose-5-phosphate-insensitive hexokinase from *Schizosaccharomyces pombe*", Biochimica et Biophysica Acta 1606(1-3):83-93 (2003).

Carlini et al., "Guerbet condensation of methanol with n-propanol to isobutyl alcohol over heterogeneous copper chromite/Mg—Al mixed oxides catalysts", J. Mol. Catal. A: Chem., vol. 220 (2004) pp. 215-220.

Dong, et al., "Glucose represses the lactose-galactose regulon in Kluyveromyces lactis through a SNF1 and MIG1-dependent pathway that modulates galactokinase (GAL1) gene expression", Nucleic Acids Research, Sep. 15, 1997, pp. 3657-3664, vol. 25, No. 18.

Durre, "New insights and novel developments in clostridial acetone/butanol/isopropanol fermentation", Appl. Microbiol. Biotechnol. (1998) vol. 49, pp. 639-648.

Flikweert, M.T., et al., "Pyruvate decarboxylase: an indispensable enzyme for growth of *Saccharomyces cerevisiae* on glucose," Yeast 12:247-257, John Wiley & Sons, Ltd., England (1996).

Groot et al., "Technologies for butanol recovery integrated with fermentations", Process Biochemistry, vol. 27 (1992) pp. 61-75.

Karp et al., "Cloning and biochemical characterization of hexokinase from the methyltrophic yeast Hansenula polymorpha", Current Genetics 44:268-76 (2004).

Laht et al., "Cloning and characterization of glucokinase from a methylotrophic yeast hansenula polymorpha: different effects on

(56) References Cited

OTHER PUBLICATIONS glucose repression in H. polymorpha and *Saccharomyces cerevisiae*", Gene 296 (2002) pp. 195-203.
Lobo et al., "Yeast hexokinase genetics", Genetics, vol. 86, pp. 727-744 (1977).
Lopez, et al., "Isocitrate lyase of the yeast Kluyveromyces lactis is subject to glucose repression but not to catabolite inactivation", Current Genetics, Jan. 2004, vol. 44, pp. 305-316.
Nystrom et al., "Reduction of organic compounds by lithium aluminum hydride", J. Am. Chem. Soc. vol. 69, p. 1198 (1947).
Petit et al., "Hexokinase regulates kinetics of glucose transport and expression of genes encoding hexose transporters in *Saccharomyces cerevisiae*", J. Bacteriology. 182(23):6815-6818 (2000).
Prior et al., "The hexokinase gene is required for transcriptional regulation of the glucose transporter gene RAG1 in kluyveromyces lactis", Molecular and Cellular Biology, Jul. 1993, p. 3882-3889.
Riera et al., "Human pancreatic-cell glucokinase: subcellular localization and glucose repression signaling function in yeast cell", Biochemical Journal 415:233-239 (2008).
Rose et al., "Molecular and biochemical characterization of the hexokinase from the starch-utilizing yeast Schwanniomyces occidentalis", Current Genetics 27:330-338 (1995).

Suleau, et al., "Transcriptomic Analysis of Extensive Changes in Metabolic Regulation in Kluyveromyces lactis Strains", Eukaryotic Cell, vol. 5, No. 8, pp. 1360-1370, Aug. 2006.
Sulter et al., "Proliferation and metabolic significance of peroxisomes in candida boidinii during growth on D-alanine or oleic acid as the sole carbon source", Arch. Microbiol., vol. 153, pp. 485-489 (1990).
Vojtek et al., "Phosphorylation of yeast hexokinases", Eur. J. Biochem., vol. 190 pp. 371-375 (1990).
Voloch et al., "Fermentation Derived 2,3-Butanediol," in Comprehensive Biotechnology, Pergamon Press Ltd., England, vol. 2, Section 3:933-947 (1986).
Westholm et al., "Combinatorial control of gene expression by the three yeast repressors Mig1, Mig2 and Mig3," BMC Genomics 9:601 (2008).
Winzeler, et al., "Functional characterization of the *S. cerevisiae* genome by gene deletion and parallel anaylsis", Science vol. 285, pp. 901-906 (1999).
International Search Report and Written Opinion of corresponding PCT/US2010/062397 patent application mailed Apr. 5, 2011.

\* cited by examiner

A

B

Isobutanol production

YEAST PRODUCTION HOST CELLS

CROSS-REFERENCE TO RELATED APPLICATIONS

This application claims the benefit of priority to U.S. Provisional Application No. 61/246,709, filed on Sep. 29, 2009, the entirety of which is herein incorporated by reference.

FIELD OF THE INVENTION

The invention relates to the field of industrial microbiology and the metabolism of yeast. More specifically, engineering yeast for increased availability of pyruvate and reduced glucose repression allows increased production of compounds in pathways that use pyruvate as an upstream substrate.

BACKGROUND OF THE INVENTION

Yeasts have been used for production of products that use naturally produced pyruvate as a starting substrate in their biosynthetic pathways. To enhance production of such products, yeasts have been engineered by expressing enzymes to alter endogenous biosynthetic pathways or introduce new pathways, and/or by disrupting expression of endogenous enzymes to alter metabolite flow. Introduced pathways that use cellular pyruvate include pathways for production of isomers of butanol, which are important industrial chemicals, useful as fuel additives, as feedstock chemicals in the plastics industry, and as foodgrade extractants in the food and flavor industry.

Disruption of pyruvate decarboxylase has been used to increase availability of pyruvate for pathways to produce desired products. For example, US20070031950 discloses a yeast strain with a disruption of one or more pyruvate decarboxylase or pyruvate dehydrogenase genes and expression of a D-lactate dehydrogenase gene, which is used for production of D-lactic acid. US2005/0059136 discloses glucose tolerant $C_2$ carbon source-independent (GCSI) yeast strains with no pyruvate decarboxylase activity, which may have an exogenous lactate dehydrogenase gene. Nevoigt and Stahl (Yeast 12:1331-1337 (1996)) describe the impact of reduced pyruvate decarboxylase and increased NAD-dependent glycerol-3-phosphate dehydrogenase in *Saccharomyces cerevisiae* on glycerol yield. US Patent Application Publication No. 20090305363 discloses increased conversion of pyruvate to acetolactate by engineering yeast for expression of a cytosol-localized acetolactate synthase and substantial elimination of pyruvate decarboxylase activity.

Reducing glucose repression has been used to improve respiratory capacity of yeast for increased biomass production. WO199826079 discloses overexpression of the Hap1 transcription factor to reduce glucose repression, resulting in increased respiratory capacity and increased biomass production. EP1728854 discloses a process for biomass production using yeast overexpressing the Hap1 transcription factor grown in aerobic conditions. Functional deletion of the HXK2 (hexokinase2) gene has been used to reduce glucose repression. Disclosed in WO2000061722 is production of yeast biomass by aerobically growing yeast having one or more functionally deleted hexokinase2 genes or analogs. Rossell et al. (Yeast Research 8:155-164 (2008)) found that *Saccharomyces cerevisiae* with a deletion of the HXK2 gene showed 75% reduction in fermentative capacity, defined as the specific rate of carbon dioxide production under sugar-excess and anaerobic conditions. After starvation, the fermentation capacity was similar to that of a strain without the HXK2 gene deletion. Diderich et al. (Applied and Environmental Microbiology 67:1587-1593 (2001)) found that *S. cerevisiae* with a deletion of the HXK2 gene had lower pyruvate decarboxylase activity.

There remains a need to improve growth and product production during fermentation of yeasts that have increased pyruvate availability due to reduction or elimination of pyruvate decarboxylase activity.

SUMMARY OF THE INVENTION

The invention provides yeast cells that are engineered to have improved growth and production of products from pathways initiating with pyruvate. The yeast cells have reduced glucose repression, and inactivation or reduced expression of one or more pyruvate decarboxylase genes to suppress endogenous competing pyruvate-utilizing metabolic pathways. In some embodiments, the yeast cells also have an engineered biosynthetic pathway for production of a product starting with pyruvate such as isobutanol, 2,3-butanediol, 2-butanone, 2-butanol, 1-butanol, valine, isoleucine, isoamyl alcohol, lactic acid, malate, or isoprenoids. The engineered yeast may be used for production of these or other products that are made starting with pyruvate, depending on the engineered product pathway in the cell.

Accordingly, a recombinant yeast production host cell is provided comprising a genetic modification which has the effect of reducing glucose repression wherein the yeast production host is pdc⁻ and wherein the unmodified yeast host cell is crabtree-positive. Preferred recombinant yeast production host cells of the invention are those having a disruption in a gene encoding a hexokinase involved in glucose repression, and that has nuclear and cytoplasmic localization.

In other embodiments, recombinant yeast production host cells are provided, said cells having reduced glucose repression, that are pdc−, and that have a pyruvate-utilizing biosynthetic pathway for production of 2,3-butanedidol, isobutanol, 2-butanone, 2-butanol, 1-butanol, valine, leucine, isoamyl alcohol, lactic acid, malate, or isoprenoids.

In another embodiment, methods are provided for the production of 2,3-butanediol, isobutanol, 2-butanone 2-butanol, 1-butanol, valine, leucine, isoamyl alcohol, lactic acid, malate, or isoprenoids comprising growing the recombinant yeast cells of the invention under conditions wherein 2,3-butanediol, isobutanol, 2-butanone, 2-butanol, 1-butanol, valine, leucine, isoamyl alcohol, lactic acid, malate, or isoprenoid is produced and optionally recovering the product.

BRIEF DESCRIPTION OF THE FIGURES AND SEQUENCE DESCRIPTIONS

The various embodiments of the invention can be more fully understood from the following detailed description, the figures, and the accompanying sequence descriptions, which form a part of this application.

Figure 4:
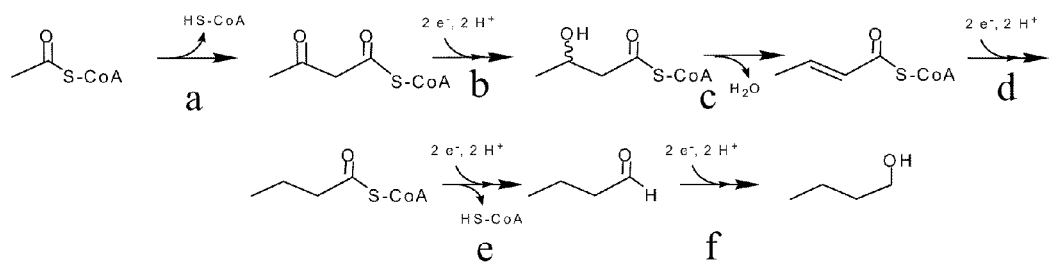

FIG. 4 a pathway for 1-butanol biosynthesis.

Figure 5:
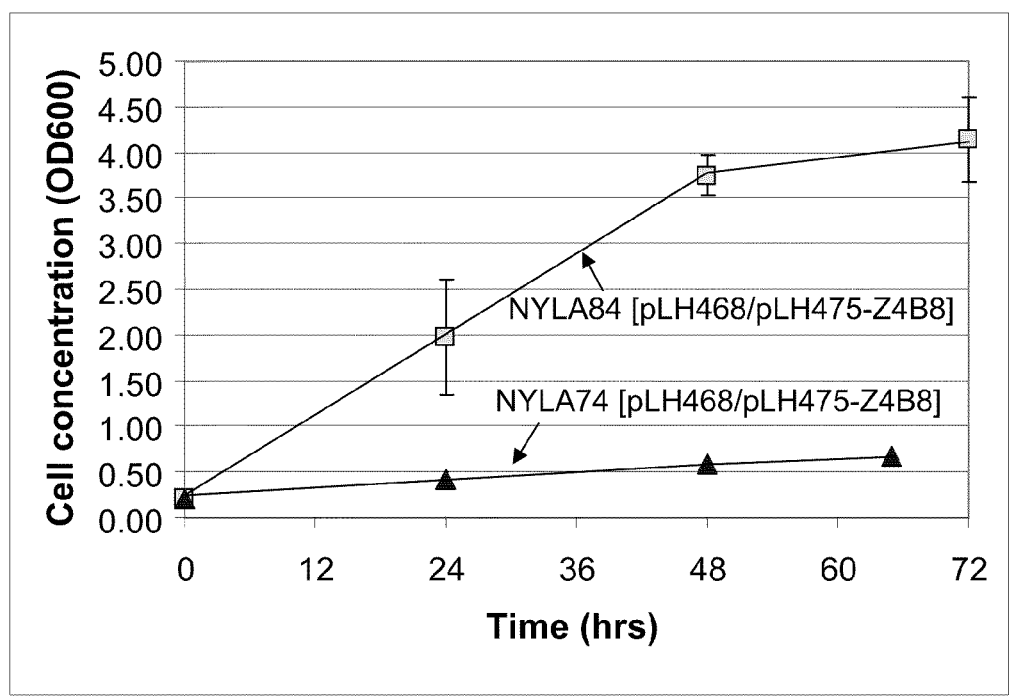

FIG. 5 shows a graph of growth of NYLA74/pLH468/pLH475-Z4B8 and NYLA84/pLH468/pLH475-Z4B8 strains in media containing 2% glucose.

Figure 6:
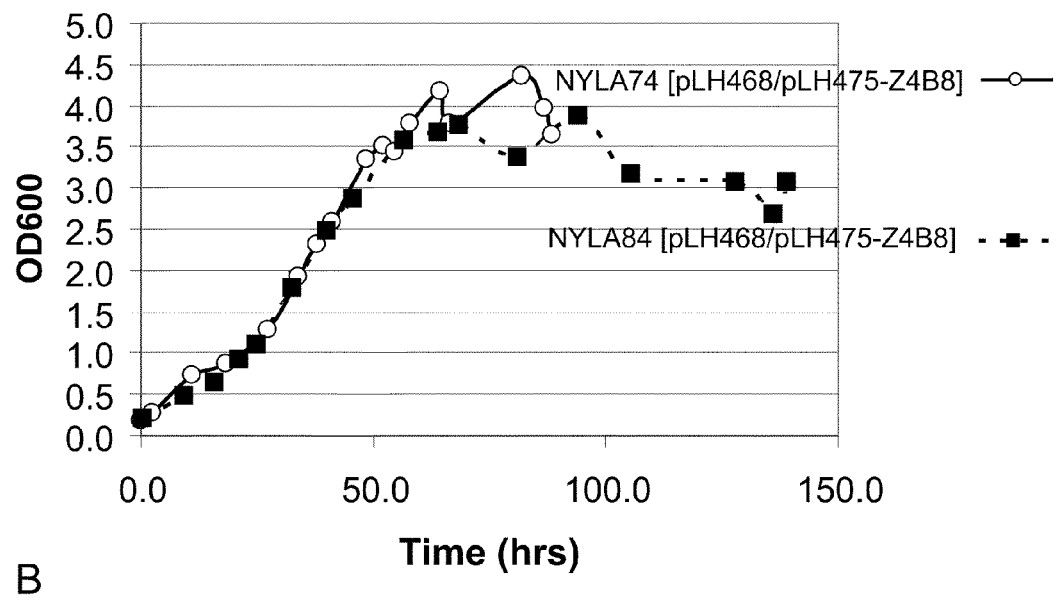
Figure 6:
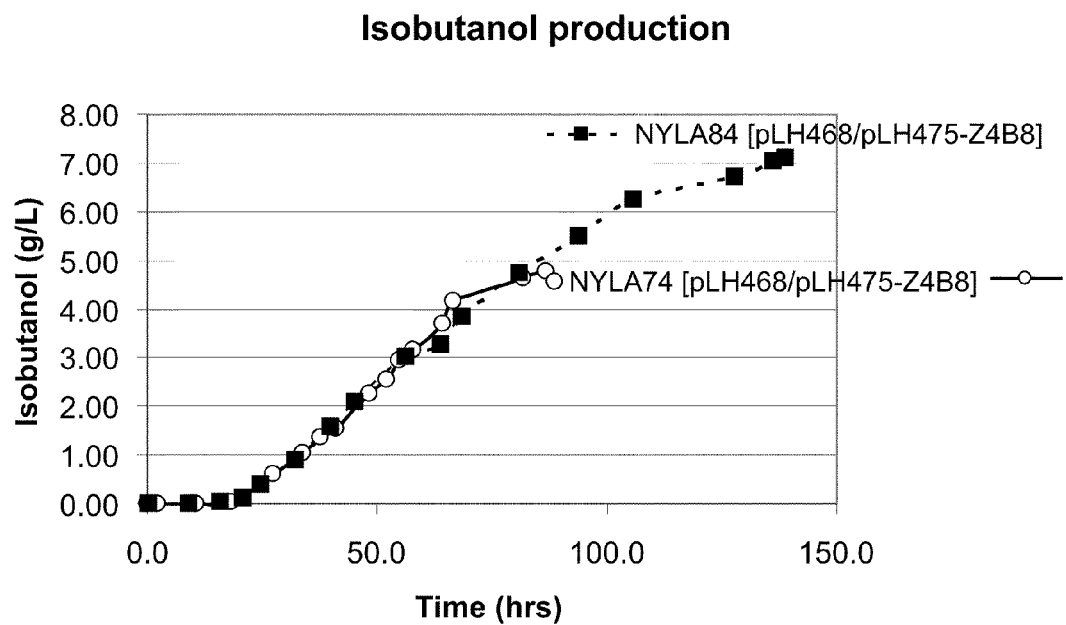

FIG. 6 shows the results comparing NYLA74/pLH468/pLH475-Z4B8 and NYLA84/pLH468/pLH475-Z4B8 strains for growth (A) and isobutanol production (B).

Figure 7:
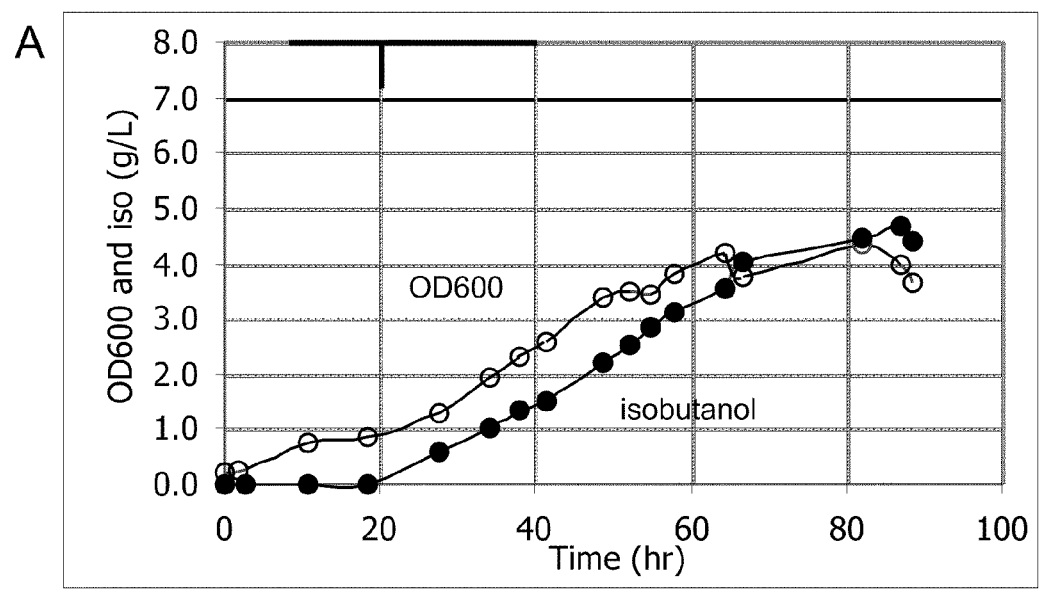
Figure 7:
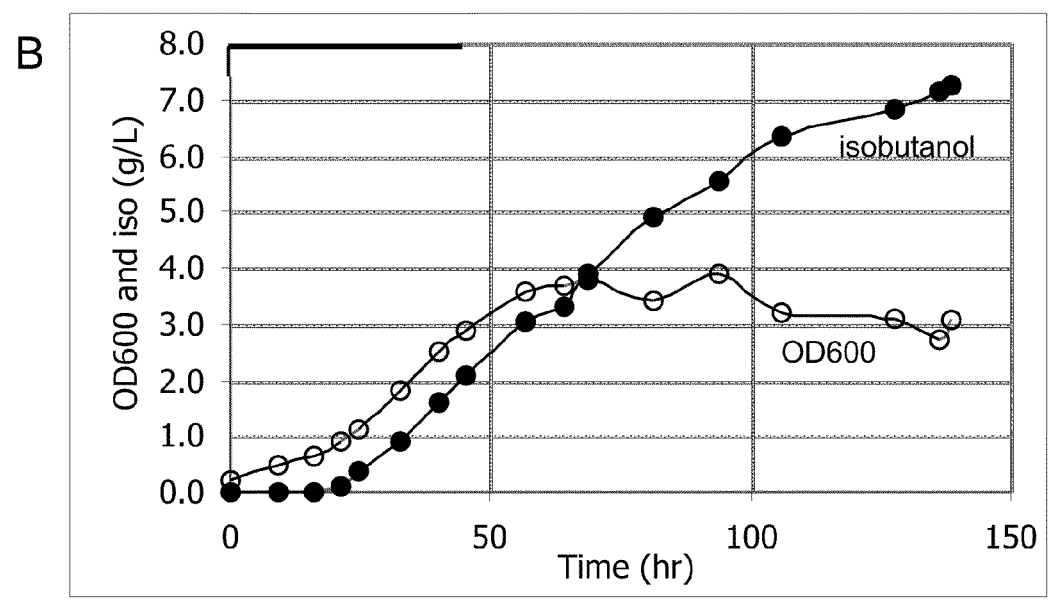

FIG. 7 shows a comparison of growth and isobutanol production for the NYLA74/pLH468/pLH475-Z4B8 strain (A) and the NYLA84/pLH468/pLH475-Z4B8 strain (B).

Figure 8:
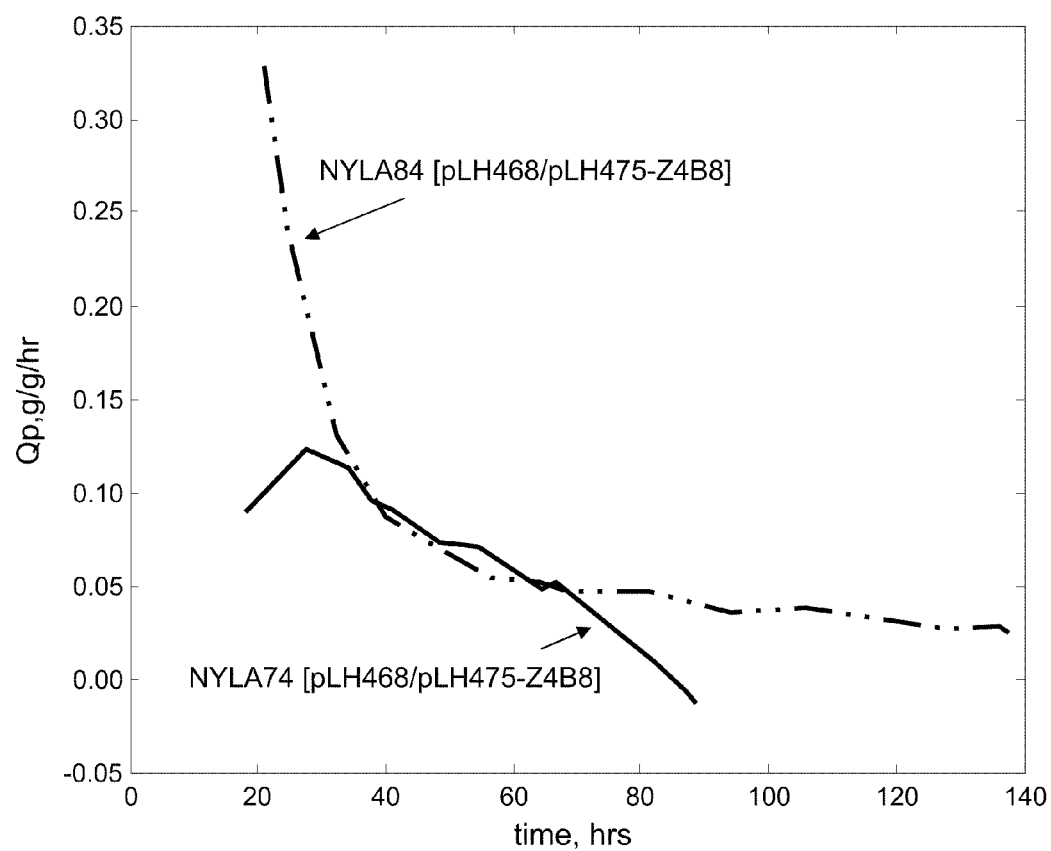

FIG. 8 plots specific productivity (Qp) measured in grams isobutanol per gram of cells over time for NYLA74/pLH468/pLH475-Z4B8 and NYLA84/pLH468/pLH475-Z4B8 strains.

The invention can be more fully understood from the following detailed description and the accompanying sequence descriptions which form a part of this application.

The following sequences conform with 37C.F.R.1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37C.F.R. §1.822.

TABLE 1

SEQ ID Numbers of Coding Regions and Proteins used to Reduce Glucose Repression

| Description | SEQ ID NO: Nucleic acid | SEQ ID NO: Amino acid |
|---|---|---|
| HAP1 from *Saccharomyces cerevisiae* | 1 | 2 |
| HAP1 from *Kluyveromyces lactis* | 3 | 4 |
| HAP1 from *Candida glabrata* | 5 | 6 |
| HAP1 from *Pichia pastoris* | 7 | 8 |
| MIG1 from *Saccharomyces cerevisiae* | 9 | 10 |
| MIG1 from *Kluyveromyces lactis* | 11 | 12 |
| MIG1 from *Pichia pastoris* | 13 | 14 |
| MIG1 from *Candida glabrata* | 15 | 16 |
| MIG2 from *Saccharomyces cerevisiae* | 17 | 18 |
| MIG2 from *Saccharomyces paradoxus* | 19 | 20 |
| MIG2 from *Saccharomyces mikatae* | 21 | 22 |
| MIG2 from *Saccharomyces kudriavzevii* | 23 | 24 |
| MIG2 from *Saccharomyces bayanus* | 25 | 26 |
| GRR1 from *Saccharomyces cerevisiae* | 27 | 28 |
| HXT1 from *Saccharomyces cerevisiae* | 29 | 30 |
| HXT2 from *Saccharomyces cerevisiae* | 31 | 32 |
| HXT3 from *Saccharomyces cerevisiae* | 33 | 34 |
| HXT4 from *Saccharomyces cerevisiae* | 35 | 36 |
| HXT5 from *Saccharomyces cerevisiae* | 37 | 38 |
| HXT6 from *Saccharomyces cerevisiae* | 39 | 40 |
| HXT7 from *Saccharomyces cerevisiae* | 41 | 42 |
| Hexokinase2 from *Saccharomyces cerevisiae* | 43 | 44 |
| Hexokinase from *Saccharomyces kluyferi* | 45 | 46 |
| Hexokinase from *Saccharomyces bayanus* | 47 | 48 |
| Hexokinase from *Saccharomyces mikatae* | 49 | 50 |
| Hexokinase from *Saccharomyces paradoxus* | 51 | 52 |
| Hexokinase from *Zygosaccharomyces rouxii* | 53 | 54 |
| Hexokinase A from *Candida glabrata* | 55 | 56 |
| Hexokinase B from *Candida glabrata* | 57 | 58 |
| Hexokinase2 from *Schizosaccharomyces pombe* | 59 | 60 |

TABLE 2

SEQ ID Numbers of PDC Target Gene coding regions and Proteins

| Description | SEQ ID NO: Nucleic acid | SEQ ID NO: Amino acid |
|---|---|---|
| PDC1 pyruvate decarboxylase from *Saccharomyces cerevisiae* | 61 | 62 |
| PDC5 pyruvate decarboxylase from *Saccharomyces cerevisiae* | 63 | 64 |
| PDC6 pyruvate decarboxylase from *Saccharomyces cerevisiae* | 65 | 66 |
| pyruvate decarboxylase from *Candida glabrata* | 67 | 68 |
| PDC1 pyruvate decarboxylase from *Pichia stipitis* | 69 | 70 |
| PDC2 pyruvate decarboxylase from *Pichia stipitis* | 71 | 72 |
| pyruvate decarboxylase from *Kluyveromyces lactis* | 73 | 74 |
| pyruvate decarboxylase from *Yarrowia lipolytica* | 75 | 76 |
| pyruvate decarboxylase from *Schizosaccharomyces pombe* | 77 | 78 |
| pyruvate decarboxylase from *Zygosaccharomyces rouxii* | 79 | 80 |

TABLE 3

SEQ ID Numbers of Expression Coding Regions and Proteins

| Description | SEQ ID NO: Nucleic acid | SEQ ID NO: Amino Acid |
|---|---|---|
| *Klebsiella pneumoniae* budB (acetolactate synthase) | 81 | 82 |
| *Bacillus subtilis* alsS (acetolactate synthase) | 83 | 84 |
| *Lactococcus lactis* als (acetolactate synthase) | 85 | 86 |
| Als *Staphylococcus aureus* | 87 | 88 |
| Als *Listeria monocytogenes* | 89 | 90 |
| Als *Streptococcus mutans* | 91 | 92 |
| Als *Streptococcus thermophilus* | 93 | 94 |
| Als *Vibrio angustum* | 95 | 96 |
| Als *Bacillus cereus* | 97 | 98 |
| budA, acetolactate decarboxylase from *Klebsiella pneumoniae* ATCC 25955 | 99 | 100 |
| alsD, acetolactate decarboxylase from *Bacillus subtilis* | 101 | 102 |
| budA, acetolactate decarboxylase from *Klebsiella terrigena* | 103 | 104 |
| budC, butanediol dehydrogenase from *Klebsiella pneumoniae* IAM1063 | 105 | 106 |
| butanediol dehydrogenase from *Bacillus cereus* | 107 | 108 |
| butB, butanediol dehydrogenase from *Lactococcus lactis* | 109 | 110 |
| BDH1 butanediol dehydrogenase from *Saccharomyces cerevisiae* | 134 | 135 |
| RdhtA, B12-indep diol dehydratase from *Roseburia inulinivorans* | 111 | 112 |
| RdhtB, B12-indep diol dehydratase reactivase from *Roseburia inulinivorans* | 113 | 114 |
| sadB, butanol dehydrogenase from *Achromobacter xylosoxidans* | 115 | 116 |
| *S. cerevisiae* ILV5 (acetohydroxy acid reductoisomerase) | 117 | 118 |
| *Vibrio cholerae* ketol-acid reductoisomerase | 119 | 120 |
| *Pseudomonas aeruginosa* ketol-acid reductoisomerase | 121 | 122 |
| *Pseudomonas fluorescens* ketol-acid reductoisomerase | 123 | 124 |
| Pf5.IlvC-Z4B8 mutant *Pseudomonas fluorescens* acetohydroxy acid reductoisomerase (codon optimized for *S. cerevisiae* expression) | 125 | 126 |
| *Lactococcus lactis* ilvC | 204 | 205 |

TABLE 3-continued

SEQ ID Numbers of Expression Coding Regions and Proteins

| Description | SEQ ID NO: Nucleic acid | SEQ ID NO: Amino Acid |
|---|---|---|
| *S. cerevisiae* ILV3 (Dihydroxyacid dehydratase; DHAD) | 127 | 128 |
| *Streptococcus mutans* ilvD (DHAD) | 129 | 130 |
| *Lactococcus lactis* kivD (branched-chain α-keto acid decarboxylase) | 131 | 132 |
| *L. lactis* kivD codon optimized for *S. cerevisiae* expression | 133 | 132* |
| *Equus caballus* alcohol dehydrogenase codon optimized for *S. cerevisiae* expression | 136 | 137 |

*The same amino acid sequence is encoded by SEQ ID NOs: 131 and 133.

SEQ ID NOs:147, 148, 152, 153, 158-167, 169-175, 177-202, 206, and 207 are sequencing and PCR primers used and described in the Examples.

SEQ ID NO:138 is the sequence of the pLH475-Z4B8 vector.

SEQ ID NO:139 is the *S. cerevisiae* CUP1 promoter.

SEQ ID NO:140 is the *S. cerevisiae* CYC1 terminator2.

SEQ ID NO:141 is the *S. cerevisiae* ILV5 promoter.

SEQ ID NO:142 is the *S. cerevisiae* ILV5 terminator.

SEQ ID NO:143 is the *S. cerevisiae* FBA promoter.

SEQ ID NO:144 is the sequence of the pLH468 vector.

SEQ ID NO:145 is the sequence of the pNY8 vector.

SEQ ID NO:146 is the *S. cerevisiae* TDH3 promoter.

SEQ ID NO:149 is the sequence of the pRS425::GPM-sadB vector.

SEQ ID NO:150 is the *S. cerevisiae* GPM1 promoter.

SEQ ID NO:151 is the *S. cerevisiae* ADH1 terminator.

SEQ ID NO:154 is the sequence of the pRS423 FBA ilvD (Strep) vector.

SEQ ID NO:155 is the *S. cerevisiae* FBA terminator.

SEQ ID NO:156 is the sequence of the GPM-sadB-ADHt fragment.

SEQ ID NO:157 is the sequence of the pUC19-URA3r vector.

SEQ ID NO:168 is the sequence of the ilvD-FBA1t fragment.

SEQ ID NO:176 is the sequence of the URA3r2 marker template DNA.

SEQ ID NO:203 is the *S. cerevisiae* CYC1 terminator.

SEQ ID NO:208 is the sequence of the pDM5-PldhL1-ilvC (*L. lactis*) vector.

SEQ ID NO:209 is the sequence of the pLH475-llvC (*L. lactis*) vector.

SEQ ID NOs: 210, 211, 214, 215, 216, 218, and 219 are primers used and described in the Examples.

SEQ ID NO: 212 is the sequence of pUC19::loxP-URA3-loxP.

SEQ ID NO: 213 is the sequence of pRS423::PGAL1-cre.

SEQ ID NO: 217 is the sequence of pUC19::loxP-kanMX-loxP.

SEQ ID NO: 220 is the sequence of pYZ067.

SEQ ID NO: 221 is the sequence of pYZ090.

DETAILED DESCRIPTION OF THE INVENTION

The present invention relates to recombinant yeast host cells engineered for improved production of compounds having pyruvate as an upstream substrate or intermediate. These compounds include, but are not limited to, isobutanol, 2,3-butanediol, 2-butanone, 2-butanol, 1-butanol, leucine, valine, isoamyl alcohol, lactic acid, malate, and isoprenoids. In addition, the present invention relates to methods of producing these compounds using the engineered yeast host cells described herein. Isobutanol, 2,3-butanediol, 2-butanone, 1-butanol, and 2-butanol are important compounds for use in replacing fossil fuels either directly or as intermediates for further chemical synthesis, in addition to applications as solvents and/or extractants. The additional compounds have uses well known in the art.

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "butanol" as used herein, refers to 2-butanol, 1-butanol, isobutanol, or mixtures thereof.

The term "isobutanol biosynthetic pathway" refers to an enzyme pathway to produce isobutanol from pyruvate.

The term "2-butanol biosynthetic pathway" refers to an enzyme pathway to produce 2-butanol from pyruvate.

The term "2-butanone biosynthetic pathway" refers to an enzyme pathway to produce 2-butanone from pyruvate.

The term "pdc–" as used herein refers to a cell that has a genetic modification to inactivate or reduce expression of at least one gene encoding pyruvate decarboxylase (PDC) so that the cell substantially or completely lacks pyruvate decarboxylase enzyme activity. If the yeast cell has more than one expressed (active) PDC gene, then each of the active PDC genes may be inactivated or have minimal expression thereby producing a pdc− cell.

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, and polysaccharides.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer or is modified in some way from its native state such as to alter its expression. Foreign genes can comprise native genes inserted into a non-native organism, or chimeric genes. A "transgene" is a gene that has been introduced into the genome by a transformation procedure.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing sites, effector bindings site and stem-loop structures.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense RNA (mRNA). Expression may also refer to translation of mRNA into a polypeptide.

As used herein the term "transformation" refers to the transfer of a nucleic acid molecule into a host cell, which may be maintained as a plasmid or integrated into the genome. Host cells containing the transformed nucleic acid molecules are referred to as "transgenic" or "recombinant" or "transformed" cells.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or other nucleotide sequences that may be linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a coding region for improved expression in a host cell, it is desirable to design the coding region such that its frequency of codon usage approaches the frequency of preferred codon usage of the host cell.

The term "codon-optimized" as it refers to coding regions of nucleic acid molecules for transformation of various hosts, refers to the alteration of codons in the coding regions of the nucleic acid molecules to reflect the typical codon usage of the host organism without altering the polypeptide encoded by the DNA.

As used herein, an "isolated nucleic acid fragment" or "isolated nucleic acid molecule" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementarity, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of about 17 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191(1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, such as from other species, wherein such polypeptides have the same or similar function or activity. Useful examples of percent identities include, but are not limited to: 24%, 30%, 35%, 40%, 45%, 50%, 55%, 60%, 65%, 70%, 75%, 80%, 85%, 90%, or 95%, or any integer percentage from 24% to 100% may be useful in describing the present invention, such as 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.*, 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

Reduced Glucose Repression Improves Productivity of pdc− Yeast

Figure 1:
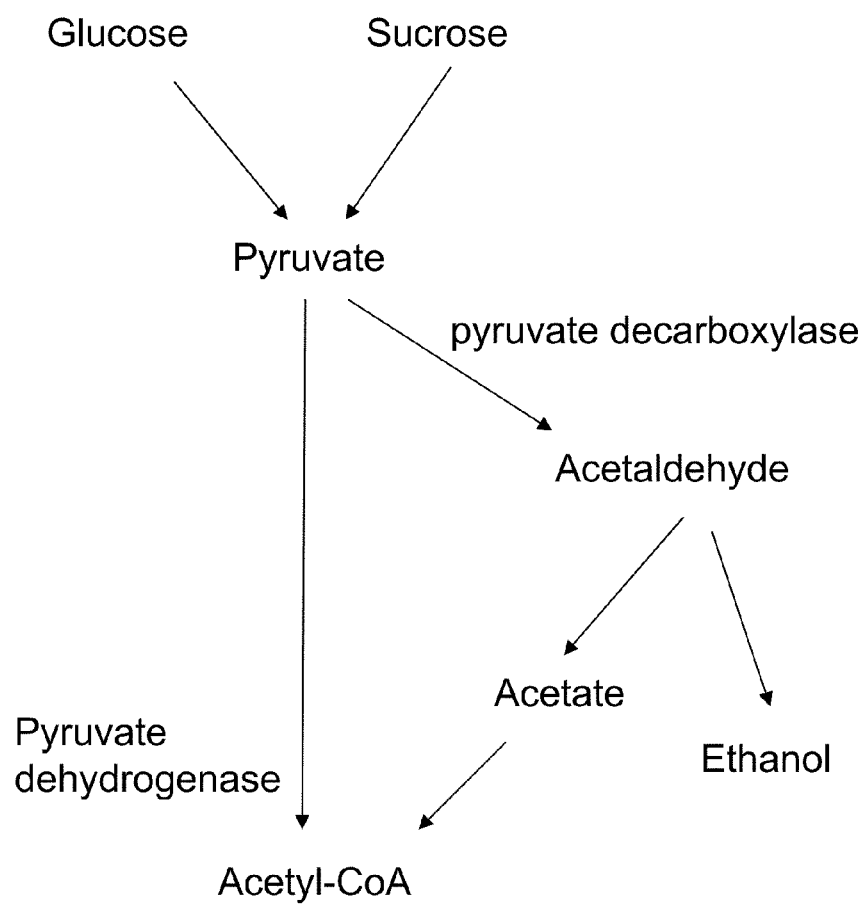
FIG. 1 shows pathways and enzymes for pyruvate utilization.

Yeast cells produce pyruvate from sugars, which is then utilized in a number of pathways of cellular metabolism including those shown in FIG. 1. One endogenous pathway is conversion of pyruvate to acetaldehyde by pyruvate decarboxylase, which is then converted to ethanol or to acetyl-CoA via acetate. Yeast cells can be engineered to produce a number of desirable products using endogenous pyruvate as a starting substrate. For product production it is desired to have increased availabililty of pyruvate. Reduction in pyruvate decarboxylase activity reduces flux to ethanol production thereby making pyruvate available for other pathways.

Applicants have discovered that reducing glucose repression in a crabtree-positive yeast cell that has been engineered to have reduced expression or inactivation of at least one pyruvate decarboxylase gene, and that has a biosynthetic pathway for production of 2,3-butanediol or isobutanol, increases growth and production of that yeast cell.

Crabtree-positive yeast cells demonstrate the crabtree effect, which is a phenomenon whereby cellular respiration is inhibited when a high concentration of glucose is added to aerobic culture medium. Glucose repression is a phenomenon whereby in the presence of high glucose, repression of expression of genes involved in respiratory metabolism and utilization of non-glucose carbon sources occurs (Gancedo (1998) Microbiol. Mol. Bio. Rev. 62:334-361). High glucose conditions are typically glucose in a concentration that is equal to or greater than about 2 g/L (0.2%). Wild type glucose-repressed crabtree-positive yeast cells display high rates of fermentation to produce ethanol.

Applicants have found that *Saccharomyces cerevisiae* cells that have genetic modifications such as deletions in the three endogenous pyruvate decarboxylase genes (such that the cells are pdc−) and have reduced glucose repression, due to genetic modification (such as a deletion) of the endogenous hexokinase2 gene, and are further engineered with an isobutanol biosynthetic pathway, grow well in medium containing 2% (20 g/L) glucose, while the same pdc− cells without reduced glucose repression have very little growth in 2% glucose. At 24 hours the cells with reduced glucose repression grew to an $OD_{600}$ of about 2.0 while the cells without reduced glucose repression grew to an $OD_{600}$ of about 0.4. At 48 hours the $OD_{600}$ readings were about 3.7 and 0.6, respectively. Thus, under the growth conditions of Example 5 herein that include a high glucose concentration of 2%, reducing glucose repression in the pdc− cells improved growth by about 5 to 6 fold.

Depending on the specific growth conditions used, including glucose concentration in the medium, other medium components and culture conditions, reducing glucose repression in a pdc− crabtree-positive yeast cell containing a pyruvate-utilizing biosynthetic pathway improves growth, as measured by $OD_{600}$, by at least about 2-, 3-, 4-, 5-, or 6-fold or greater.

Applicants have found that crabtree-positive yeast cells that are pdc− and have reduced glucose repression, due to deletion or other modifcation of the hexokinase2 gene (HXK2) (such that HXK2 expression is substantially reduced or eliminated such that hexokinase2 enzyme activity is minimal compared to wild type or eliminated), produce more products using engineered biosynthetic pathways using pyruvate as a substrate than the same pdc− cells without reduced glucose repression. When isobutanol producing pdc− crabtree-positive yeast cells with and without HXK2 enzyme activity were grown under conditions where their growth rates were similar, which is about 0.01%-0.2% glucose for the strain with HXK2 enzyme activity and about 0.5%-1.5% glucose for the strain without HXK2 enzyme activity, more isobutanol was produced by the strain without HXK2 enzyme activity. Isobutanol production continued after growth stopped, which did not occur in the HXK2 expressing strain. Thus the strain without HXK2 enzyme activity produced about 40% more isobutanol in 140 hours under the conditions described in Example 6.

In addition, pdc− crabtree-positive yeast cells with reduced glucose repression, due to modified or deleted HXK2, and having an engineered 2,3-butanediol (BDO) pathway produced more BDO than cells without the HXK2 modification when grown in 2% glucose. About 17% more BDO was produced in 48 hours.

Thus, depending on variables including fermentation medium and conditions, and engineered pyruvate-utilizing biosynthetic pathway in the cells, product production may be increased by at least about 15%, 20%, 25%, 30%, 35%, 40% or greater in yeast cells, derived from a crabtree-positive strain, that are pdc– and have reduced glucose repression as compared to the same cells without reduced glucose repression.

Reducing Glucose Repression

Glucose repression may be reduced in any crabtree-positive yeast that is amenable to genetic engineering manipulations to create the present cells. Examples of crabtree-positive yeast that may be used include *Saccharomyces, Zygosaccharomyces, Schizosaccharomyces, Dekkera, Torulopsis, Brettanomyces*, and some species of *Candida*. Species include, but are not limited to, *Saccharomyces cerevisiae, Saccharomyces kluyveri, Schizosaccharomyces pombe, Saccharomyces bayanus, Saccharomyces mikitae*, and *Saccharomyces paradoxus, Zygosaccharomyces rouxii*, and *Candida glabrata*. Any of these or other yeasts that undergo glucose repression (crabtree-positive) may be engineered to be a production host cell of the present invention.

Glucose repression may be reduced by any method that reduces the effect of high glucose concentration on a crabtree-positive cell. Methods may include altering expression of transcription factors involved in glucose repression effects. For example, increased expression of the Hap1 transcription activator or reduced expression of the Mig1 or Mig2 transcription repressor may be used to reduce glucose repression. Hap1 (Heme activated protein 1) is a zinc finger transcription activator that regulates multiple genes involved in respiratory metabolism in response to the availability of oxygen. Mig1 and Mig2 repress a largely overlapping set of genes in the presence of concentrations including genes involved in phosphate metabolism and the hexose transporter HXT4 (Westholm et al. (2008) BMC Genomics 9:601).

Glucose repression may also be reduced by reducing expression of GRR1 (Glucose Repression Resistant) which is a component of the SCF ubiquitin-ligase complex that is involved in carbon catabolite repression, glucose-dependent divalent cation transport, high-affinity glucose transport, morphogenesis, and sulfite detoxification. GRR1 appears to be a primary factor in the glucose repression pathway (Flick and Johnston (1991) Mol Cell. Biol. 11:510-512).

Glucose repression may also be reduced by attenuating glucose transport capacity of a crabtree-positive yeast cell (Henricsson et al., (2005) Appl. Environ. Microbiol. 71:6185-92; Ye et al. (1999) J. Bacteriol. 181:4673-5)). Reducing the rate of glucose transport may be achieved by inactivation of hexose transporter genes including HXT1, HXT2, HX3, HXT4, HXT5, HXT6, and/or HXT7. Preferably, all endogenous HXT genes are inactivated and a low level of glucose transport activity is engineered, for example, by expressing a HXT coding region from a weak promoter, or expressing a glucose transport protein with reduced activity (Elbing et al. (2004) Appl. Environ. Microbiol. 70:5323-30).

Any HAP1 coding sequence for a Hap1 transcription activator having at least about 80-85%, 85%-90%, 90%-95%, or at least about 96%, 97% or 98% sequence identity to any of those with SEQ ID NOs:2, 4, 6, or 8 that functions in glucose repression may be overexpressed to reduce glucose repression. Any endogenous MIG1 gene that encodes a Mig1 transcription repressor having at least about 80-85%, 85%-90%, 90%-95%, or at least about 96%, 97%, 98%, or 99% sequence identity to any of those with SEQ ID NOs:10, 12, 14, or 16 that functions in glucose repression may be reduced in expression to reduce glucose repression. Though these sequences are not all from crabtree-positive yeasts, the sequences may be used to identify MIG1 target sequences in crabtree-positive yeasts. Any endogenous MIG2 gene that encodes a Mig2 transcription repressor having at least about 80-85%, 85%-90%, 90%-95%, or at least about 96%, 97%, 98%, or 99% sequence identity to any of those with SEQ ID NOs:18, 20, 22, 24, or 26 that functions in glucose repression may be reduced in expression to reduce glucose repression. Any endogenous GRR1 gene that encodes a Grr1 protein component of the SCF ubiquitin-ligase complex having at least about 80-85%, 85%-90%, 90%-95%, or at least about 96%, 97%, or 98% sequence identity to SEQ ID NO:28 that functions in glucose repression may be reduced in expression to reduce glucose repression. Any endogenous HXT gene that encodes an Hxt hexose transporter having at least about 80-85%, 85%-90%, 90%-95%, or at least about 96%, 97%, 98%, or 99% sequence identity to any of those with SEQ ID NOs:30, 32, 34, 36, 38, 40, or 42 that functions in glucose transport may be reduced in expression to reduce glucose repression. Identities are based on the Clustal W method of alignment using the default parameters of GAP PENALTY=10, GAP LENGTH PENALTY=0.1, and Gonnet 250 series of protein weight matrix.

Preferably glucose repression is reduced by disrupting expression of the endogenous hexokinase2 gene (HXK2) of *Saccharomyces cerevisiae*, or of functionally equivalent genes in other crabtree-positive yeasts. Hexokinases that modulate glucose repression are members of the EC 2.7.1.1 group that are present both in the cytosol and the nucleus, and function in the nucleus in signaling glucose-induced repression of genes including HXK1 and GLK1. Examples of hexokinase genes that encode these regulatory hexokinases, having nuclear and cytoplamsic localization, that may be modified or inactivated to reduce glucose repression in yeast production host cells include those with coding regions listed in Table 1 with SEQ ID NOs:44, 46, 48, 50, 52, 54, 56, 58, and 60. Hexokinase genes that function in glucose repression may be identified by different names including hexokinase, hexokinase2, hexokinaseA, and hexokinaseB. Any hexokinase gene that encodes a hexokinase protein having at least about 80-85%, 85%-90%, 90%-95%, or at least about 96%, 97%, 98%, or 99% sequence identity to any of those with SEQ ID NOs: 44, 46, 48, 50, 52, 54, 56, 58, or 60 that functions in glucose repression may be inactivated to reduce glucose repression. Identities are based on the Clustal W method of alignment using the default parameters of GAP PENALTY=10, GAP LENGTH PENALTY=0.1, and Gonnet 250 series of protein weight matrix.

Additional Hap1, Mig1, Mig2, Grr1, Hxt, or Hxk (may be 2, A, or B) sequences that may be used in the present strains may be identified in the literature and in bioinformatics databases as is well known to the skilled person. Identification of coding and/or protein sequences using bioinformatics is typically through BLAST (described above) searching of publicly available databases with known Hap1, Mig1, Mig2, Grr1, Hxt, or Hxk (including 2, A, or B) encoding sequences or encoded amino acid sequences, such as those provided herein. Identities are based on the Clustal W method of alignment as specified above.

Additionally, the sequences described herein or those recited in the art may be used to identify other homologs in nature. For example each of the Hap1 encoding nucleic acid fragments described herein may be used to isolate genes encoding homologous proteins. Isolation of homologous genes using sequence-dependent protocols is well known in the art. Examples of sequence-dependent protocols include, but are not limited to: 1) methods of nucleic acid hybridization; 2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., Proc. Acad. Sci. USA 82:1074 (1985); or strand displacement amplification (SDA), Walker, et al., Proc. Natl. Acad. Sci. U.S.A., 89:392 (1992)]; and 3) methods of library construction and screening by complementation.

Methods for increasing or for reducing gene expression of the target genes above are well known to one skilled in the art. Methods for gene expression in yeasts are known in the art as described, for example, in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). For example, methods for increasing expression such as for Hap1 or other positive factors for reducing glucose repression include increasing the number of genes that are integrated in the genome or on plasmids that express the target protein, and using a promoter that is more highly expressed than the natural promoter. Promoters that may be operably linked in a constructed chimeric gene for expression of a Hap1 transcription activator include, for example, constitutive promoters FBA1, TDH3, ADH1, and GPM1, and the inducible promoters GAL1, GAL10, and CUP1. Suitable transcriptional terminators that may be used in a chimeric gene construct for expression include, but are not limited to FBA1t, TDH3t, GPM1t, ERG10t, GAL1t, CYC1t, and ADH1t.

Suitable promoters, transcriptional terminators, and coding regions may be cloned into *E. coli*-yeast shuttle vectors, and transformed into yeast cells as described in the Examples. These vectors allow for propagation in both *E. coli* and yeast strains. Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2µ origin of replication, and a marker for nutritional selection. The selection markers for these four vectors are HIS3 (vector pRS423), TRP1 (vector pRS424), LEU2 (vector pRS425) and URA3 (vector pRS426). Construction of expression vectors with a chimeric gene encoding Hap1 may be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a 21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by DNA sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR (Horton et al. (1989) Gene 77:61-68) or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Moreover, promoter replacement methods may be used to exchange the endogenous transcriptional control elements allowing another means to modulate expression such as described in Mnaimneh et al. ((2004) Cell 118(1):31-44). Expression may be modulated for increased or decreased expression using promoter replacement.

Methods for reducing expression which may be used to reduce expression of Mig1, Mig2, Grr1, Hxt, Hxk2 or other negative factors for reducing glucose repression include using genetic modification of the encoding genes. Many methods for genetic modification of target genes to reduce or eliminate expression are known to one skilled in the art and may be used to create the present yeast production host cells. Modifications that may be used include, but are not limited to, deletion of the entire gene or a portion of the gene encoding the protein, inserting a DNA fragment into the encoding gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less active protein is expressed. In addition, expression of a target gene may be blocked by expression of an antisense RNA or an interfering RNA, and constructs may be introduced that result in cosuppression. In addition, the synthesis or stability of the transcript may be lessened by mutation. Similarly the efficiency by which a protein is translated from mRNA may be modulated by mutation. All of these methods may be readily practiced by one skilled in the art making use of the known or identified sequences encoding target proteins.

DNA sequences surrounding a target coding sequence are also useful in some modification procedures and are available for yeasts such as for *Saccharomycse cerevisiae* in the complete genome sequence coordinated by Genome Project ID9518 of Genome Projects coordinated by NCBI (National Center for Biotechnology Information) with identifying GOPID #13838. An additional example of yeast genomic sequences include that of *Candida albicans*, which is included in GPID #10771, #10701 and #16373. Other yeast genomic sequences can be readily found by one of skill in the art in publicly available databases.

In particular, DNA sequences surrounding, for example, a target hexokinase coding sequence are useful for modification methods using homologous recombination. For example, in this method hexokinase gene flanking sequences are placed bounding a selectable marker gene to mediate homologous recombination whereby the marker gene replaces the hexokinase gene. Also partial hexokinase gene sequences and hexokinase gene flanking sequences bounding a selectable marker gene may be used to mediate homologous recombination whereby the marker gene replaces a portion of the target hexokinase gene. In addition, the selectable marker may be bounded by site-specific recombination sites, so that following expression of the corresponding site-specific recombinase, the resistance gene is excised from the hexokinase gene without reactivating the latter. The site-specific recombination leaves behind a recombination site which disrupts expression of the hexokinase protein. The homologous recombination vector may be constructed to also leave a deletion in the hexokinase gene following excision of the selectable marker, as is well known to one skilled in the art.

Deletions may be made using mitotic recombination as described in Wach et al. ((1994) Yeast 10:1793-1808). This method involves preparing a DNA fragment that contains a selectable marker between genomic regions that may be as short as 20 bp, and which bound a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in Methods in Enzymology, v 194, pp 281-301 (1991)).

In addition, target gene encoded activity may be disrupted using random mutagenesis, which is followed by screening to identify strains with reduced glucose repression. Using this type of method, the DNA sequence of the target gene encoding region, or any other region of the genome affecting glucose repression, need not be known. A screen for reduced glucose repression is particularly useful to identify cells with reduced hexokinase activity or other mutants that reduce glucose repression which may be useful in the present yeast production host cells.

Methods for creating genetic mutations are common and well known in the art and may be applied to the exercise of creating rmutants. Commonly used random genetic modification methods (reviewed in *Methods in Yeast Genetics*, 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of yeast cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed in Spencer et al (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics*, 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al (Mutagenesis in Yeast, 1996, *Yeast Protocols: Methods in Cell and Molecular Biology*. Humana Press, Totowa, N.J.). Introduction of a mutator phenotype can also be used to generate random chromosomal mutations in yeast. Common mutator phenotypes can be obtained through disruption of one or more of the following genes: PMS1, MAG1, RAD18 or RAD51. Restoration of the non-mutator phenotype can be easily obtained by insertion of the wildtype allele. Collections of modified cells produced from any of these or other known random mutagenesis processes may be screened for reduced hexokinase activity.

Reduced Pyruvate Decarboxylase Activity

Glucose repression is reduced in a pdc– yeast cell by additionally reducing expression of HXK2. Genetic modifications for disrupting or reducing expression of PDC genes and for reducing glucose repression, such as disrupting *S. cerevisiae* HXK2 or altering expression of other genes as described above, may be engineered in any order.

Yeasts may have one or more genes encoding pyruvate decarboxylase. For example, there is one gene encoding pyruvate decarboxylase in *Candida glabrata* and *Schizosaccharomyces pombe*, while there are three isozymes of pyruvate decarboxylase encoded by the PDC1, PCD5, and PDC6 genes in *Saccharomyces*. In the present yeast cells at least one PDC gene is inactivated. If the yeast cell used has more than one expressed (active) PDC gene, then each of the active PDC genes may be modified or inactivated thereby producing a pdc– cell. For example, in *S. cerevisiae* the PDC1, PDC5, and PDC6 genes may be modified or inactivated. Though if a PDC gene is not active under the fermentation conditions to be used then such a gene would not need to be modified or inactivated.

*Saccharomyces* strains having no pyruvate decarboxylase activity are available from the ATCC with Accession #200027 and #200028.

Examples of yeast pyruvate decarboxylase genes (PDC) that may be targeted for inactivation in the present yeast production host cells are those encoding proteins of SEQ ID NOs:62, 64, 66, 68, and 78. Other target genes, such as those encoding pyruvate decarboxylase proteins having at least about 80-85%, 85%-90%, 90%-95%, or at least about 96%, 97%, 98%, or 99% sequence identity to the pyruvate decarboxylases of SEQ ID NOs:62, 64, 66, 68, 70, 72, 74, 76, 78, or 80 may be identified in the literature and in bioinformatics databases well known to the skilled person. Though these sequences are not all from crabtree-positive yeasts, the sequences may be used to identify PDC target sequences in crabtree-positive yeasts. Identification of PDC genes from additional yeasts using bioinformatics is typically through BLAST (described above) searching of publicly available databases with known pyruvate decarboxylase encoding sequences or pyruvate decarboxylase amino acid sequences, such as those provided herein. Identities are based on the Clustal W method of alignment using the default parameters of GAP PENALTY=10, GAP LENGTH PENALTY=0.1, and Gonnet 250 series of protein weight matrix.

Additionally, the sequences described herein or those recited in the art may be used to identify homologs in other yeast strains experimentally, as described above for identification of hexokinase encoding genes.

Genes encoding pyruvate decarboxylase may be disrupted in the present yeast cells using genetic modification methods as described above for target hexokinase gene disruption.

Engineered Biosynthetic Pathways Using Pyruvate

The present yeast production host cells that have reduced glucose repression and that are pdc− are engineered to have a biosynthetic pathway for production of a product from pyruvate. The features of the cell may be engineered in any order. Any product made using a biosynthetic pathway that has pyruvate as the initial substrate may be produced with greater effectiveness in a yeast strain disclosed herein that has inactivation of at least one pyruvate decarboxylase gene and reduced glucose repression.

The biosynthetic pathway of the present host cell may be any pathway that utilizes pyruvate and produces a desired product. The pathway genes may include endogenous genes and/or heterologous genes. Typically at least one gene, or at least two, three, four, or all genes are heterologous in the biosynthetic pathway. It is preferred that the engineered biosynthetic pathway provides at least partial redox balance to the cell. At least partial redox balance may be achieved, for example, by including an enzyme in the engineered biosynthetic pathway that requires NADH for its activity. Utilizing NADH balances production of NADH during conversion of glucose to pyruvate. In wild type cells NADH is utilized in conversion of glucose to glycerol, and in production of ethanol from pyruvate. The present pdc− production yeast cells have unbalanced NADH due to disruption of ethanol production. Any method of increasing NADH-dependent enzyme activity in the present production host cell may be used in balancing redox. In addition to including a NADH-dependent enzyme in the biosynthetic pathway, methods include expressing an enzyme that requires NADH but that is not part of the engineered pyruvate-utilizing biosynthetic pathway. A redox-balancing NADH-dependent enzyme may be expressed from a heterologous gene. Alternatively, expression of an endogenous gene encoding an NADH-dependent enzyme may be increased to provide increased NADH-dependent enzyme activity.

A biosynthetic pathway for producing 2,3-butanediol may be engineered in the present yeast production host cell as disclosed in US Patent Application Publication No. 2009030536, which is herein incorporated by reference. The 2,3-butanediol pathway is a portion of the 2-butanol biosynthetic pathway that is disclosed in US Patent Pub No. US20070292927A1 (FIG. 2 steps a, b, and i), which is herein incorporated by reference. Pathway steps include conversion of pyruvate to acetolactate by acetolactate synthase, conversion of acetolactate to acetoin by acetolactate decarboxylase, and conversion of acetoin to 2,3-butanediol by butanediol dehdyrogenase. Butanediol dehydrogenase requires NADH and thereby contributes to redox balance.

As disclosed in US Patent Application Publication No. 2009-0305363, for production of 2,3-butanediol in yeast pdc− host cells, acetolactate synthase is expressed in the cytosol. Acetolactate synthase enzymes, which also may be called acetohydroxy acid synthase, belong to EC 2.2.1.6 (switched from 4.1.3.18 in 2002), are well-known, and they participate in the biosynthetic pathway for the proteinogenic amino acids leucine and valine, as well as in the pathway for fermentative production of 2,3-butanediol from acetoin in a number of organisms. The skilled person will appreciate that polypeptides having acetolactate synthase activity isolated from a variety of sources may be used in the present cells. Acetolactate synthase (Als) enzyme activities that have substrate preference for pyruvate over ketobutyrate are of particular utility, such as those encoded by alsS of *Bacillus* and budB of *Klebsiella* (Gollop et al., *J. Bacteriol.* 172(6):3444-3449 (1990); Holtzclaw et al., *J. Bacteriol.* 121(3):917-922 (1975)). Als from *Bacillus subtilis* (DNA: SEQ ID NO:83; protein: SEQ ID NO:84), from *Klebsiella pneumoniae* (DNA: SEQ ID NO:81; protein: SEQ ID NO:82), and from *Lactococcus lactis* (DNA: SEQ ID NO:85; protein: SEQ ID NO:86) are provided herein.

Additional Als coding regions and encoded proteins that may be used include those from *Staphylococcus aureus* (DNA: SEQ ID NO:87; protein: SEQ ID NO:88), *Listeria monocytogenes* (DNA: SEQ ID NO:89; protein: SEQ ID NO:90), *Streptococcus mutans* (DNA: SEQ ID NO:91; protein: SEQ ID NO:92), *Streptococcus thermophilus* (DNA: SEQ ID NO:93; protein: SEQ ID NO:94), *Vibrio angustum* (DNA: SEQ ID NO:95; protein: SEQ ID NO:96), and *Bacillus cereus* (DNA: SEQ ID NO:97; protein: SEQ ID NO:98). Any Als gene that encodes an acetolactate synthase having at least about 80-85%, 85%-90%, 90%-95%, or at least about 96%, 97%, or 98% sequence identity to any of those with SEQ ID NOs:82, 84, 86, 88, 90, 92, 94, 96, or 98 that converts pyruvate to acetolactate may be used. Identities are based on the Clustal W method of alignment using the default parameters of GAP PENALTY=10, GAP LENGTH PENALTY=0.1, and Gonnet 250 series of protein weight matrix.

Additionally, US Patent Application Publication No. 2009030536 provides a phylogenetic tree depicting acetolactate synthases that are the 100 closest neighbors of the *B. subtilis* AlsS sequence, any of which may be used. Additional Als sequences that may be used in the present strains may be identified in the literature and in bioinformatics databases as is well known to the skilled person. Identification of coding and/or protein sequences using bioinformatics is typically through BLAST (described above) searching of publicly available databases with known Als encoding sequences or encoded amino acid sequences, such as those provided herein. Identities are based on the Clustal W method of alignment as specified above. Additionally, the sequences described herein or those recited in the art may be used to identify other homologs in nature as described above.

Cytosolic expression of acetolactate synthase is achieved by transforming with a gene comprising a sequence encoding an acetolactate synthase protein, with no mitochondrial targeting signal sequence. Methods for gene expression in yeasts are known in the art (see for example *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Expression using chimeric genes (including promoters and terminators), vectors, cloning methods, and integration methods are as described above.

Conversion of acetolactate to acetoin is by an acetolactate decarboxylase enzyme, known as EC 4.1.1.5 which is available, for example, from *Bacillus subtilis* (DNA: SEQ ID NO:101; Protein: SEQ ID NO:102), *Klebsiella terrigena* (DNA: SEQ ID NO:103, Protein: SEQ ID NO:104) and *Klebsiella pneumoniae* (DNA: SEQ ID NO:99, protein: SEQ ID NO:100). Any gene that encodes an acetolactate decarboxylase having at least about 80-85%, 85%-90%, 90%-95%, or at least about 96%, 97%, or 98% sequence identity to any of those with SEQ ID NOs:100, 102, or 104 that converts acetolactate to acetoin may be used.

Conversion of acetoin to 2,3-butanediol is by a butanediol dehdyrogenase enzyme, also known as acetoin reductase.

Butanediol dehydrogenase enzymes may have specificity for production of (R)- or (S)-stereochemistry in the alcohol product. (S)-specific butanediol dehydrogenases are known as EC 1.1.1.76 and are available, for example, from *Klebsiella pneumoniae* (DNA: SEQ ID NO:105; protein: SEQ ID NO:106). (R)-specific butanediol dehydrogenases are known as EC 1.1.1.4 and are available, for example, from *Bacillus cereus* (DNA: SEQ ID NO:107, protein: SEQ ID NO:108), *Lactococcus lactis* (DNA: SEQ ID NO:109, protein: SEQ ID NO:110), and *Saccharomyces cerevisiae* (BDH1; DNA: SEQ ID NO:134, protein: SEQ ID NO:135). Any gene that encodes a butanediol dehydrogenase having at least about 80-85%, 85%-90%, 90%-95%, or at least about 98% sequence identity to any of those with SEQ ID NOs:106, 108, 110 or 135 that converts acetoin to 2,3-butanediol may be used.

Additional acetolactate decarboxylase or butanediol dehydyrogenase sequences that may be used in the present strains may be identified in the literature and in bioinformatics databases as is well known to the skilled person. Identification of coding and/or protein sequences using bioinformatics is typically through BLAST (described above) searching of publicly available databases with known acetolactate decarboxylase or butanediol dehdyrogenase encoding sequences or encoded amino acid sequences, such as those provided herein. Identities are based on the Clustal W method of alignment as specified above. Additionally, the sequences described herein or those recited in the art may be used to identify other homologs in nature as described above.

Biosynthetic pathways for production of 2-butanone or 2-butanol that may be engineered in the present cells are disclosed in US Patent Application Publication Nos: US20070292927A1 and US20070259410A1, which are herein incorporated by reference. A diagram of the disclosed 2-butanone and 2-butanol biosynthetic pathways is provided in FIG. 2. 2-Butanone is the product made when the last depicted step of converting 2-butanone to 2-butanol is omitted. The pathway in US Patent Publication No. US20070292927 is as described above for BDO production with the addition of the following steps:

2,3-butanediol to 2-butanone (FIG. 2 step j) as catalyzed for example by diol dehydratase or glycerol dehydratase; and
2-butanone to 2-butanol (FIG. 2 step f) as catalyzed for example by butanol dehydrogenase.

Diol dehydratases, also known as butanediol dehydratases, which utilize the cofactor adenosyl cobalamin (vitamin B12) are known as EC 4.2.1.28. Glycerol dehydratases that also utilize the cofactor adenosyl cobalamin are known as EC 4.2.1.30. Diol and glycerol dehydratases have three subunits that are required for activity. Provided in US Patent Publication No. US20070292927A1 are sequences of the three subunits of many diol and glycerol dehydratases that may be used in a 2-butanone or 2-butanol pathway in the present cells, as well as the preparation and use of a Hidden Markov Model to identify additional diol and dehydratase enzymes that may be used.

Butanol dehydrogenases are a subset of a broad family of alcohol dehydrogenases and may be NAD- or NADP-dependent. The NAD-dependent enzymes are known as EC 1.1.1.1 and the NADP-dependent enzymes are known as EC 1.1.1.2. Provided in US Patent Publication No, US20070292927A1 are sequences of butanol dehydrogenases that may be used in the disclosed 2-butanol biosynthetic pathway in the present cells.

Described in US Patent Publication No. US20090155870 A1, which is herein incorporated by reference, are construction of chimeric genes and genetic engineering of yeast for 2-butanol production using the US Patent Publication No. US20070292927A1 disclosed biosynthetic pathway. Further description for gene construction and expression is above and in the Examples herein.

The use in this pathway in yeast of the butanediol dehydratase from *Roseburia inulinivorans*, RdhtA, (protein SEQ ID NO:112, coding region SEQ ID NO:11) is disclosed in US Patent Publication No. US 20090155870 A1. This enzyme is used in conjunction with the butanediol dehydratase reactivase from *Roseburia inulinivorans*, RdhtB, (protein SEQ ID NO:114, coding region SEQ ID NO: 113). This butanediol dehydratase is desired in many hosts because it does not require coenzyme $B_{12}$. Another $B_{12}$-independent diol dehydratase that may be used is one from *Klebsiella pneumoniae*, having three subunits: pduC, pduD, and pduE, that is disclosed in WO2009046370.

Figure 2:
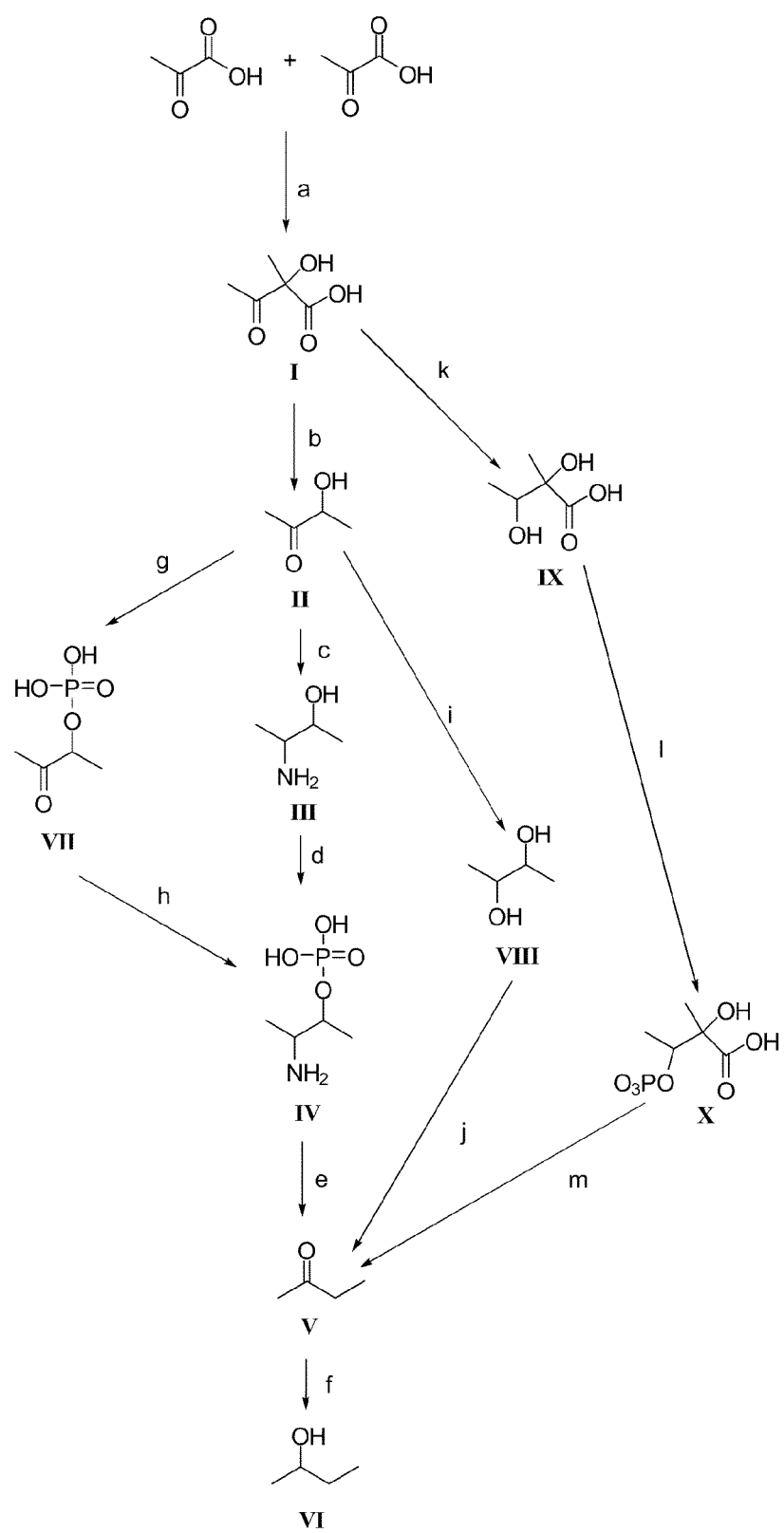
FIG. 2 shows four different 2-butanol biosynthetic pathways.

Useful for the last step of converting 2-butanone to 2-butanol in all pathways of FIG. 2 is a new butanol dehydrogenase isolated from an environmental isolate of a bacterium identified as *Achromobacter xylosoxidans* that is disclosed in US Patent Application Publication No. 20090269823 (DNA: SEQ ID NO:115, protein SEQ ID NO:116), which is herein incorporated by reference.

Genes and their expression for other pathways of FIG. 2 are disclosed in US Patent Publication No. US20070259410A1.

Figure 3:
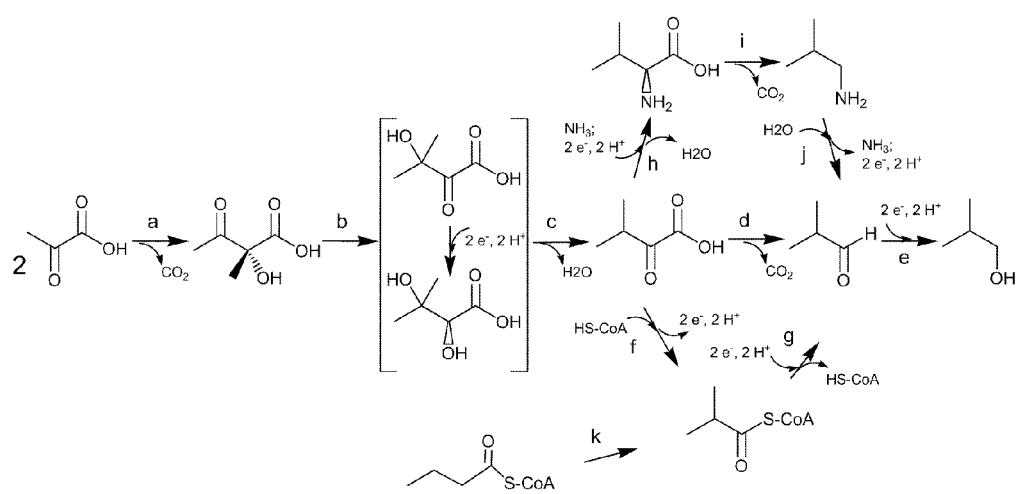
FIG. 3 shows three different isobutanol biosynthetic pathways.

Biosynthetic pathways for production of isobutanol that may be engineered in the present cells are disclosed in US Patent Publication No. US20070092957 A1, which is herein incorporated by reference. A diagram of the disclosed isobutanol biosynthetic pathways is provided in FIG. 3.

As described in US 20070092957 A1, steps in an example isobutanol biosynthetic pathway include conversion of:
pyruvate to acetolactate (FIG. 3 pathway step a) as catalyzed for example by acetolactate synthase (ALS) known by the EC number 2.2.1.69;
acetolactate to 2,3-dihydroxyisovalerate (FIG. 3 pathway step b) as catalyzed for example by acetohydroxy acid isomeroreductase, also called ketol-acid reductoisomerase (KARI) known by the EC number 1.1.1.86;
2,3-dihydroxyisovalerate to α-ketoisovalerate (FIG. 3 pathway step c) as catalyzed for example by acetohydroxy acid dehydratase, also called dihydroxy-acid dehydratase (DHAD) known by the EC number 4.2.1.9;
α-ketoisovalerate to isobutyraldehyde (FIG. 3 pathway step d) as catalyzed for example by branched-chain α-keto acid decarboxylase known by the EC number 4.1.1.72 or 4.1.1.1; and
isobutyraldehyde to isobutanol (FIG. 3 pathway step e) as catalyzed for example by branched-chain alcohol dehydrogenase known by the EC number 1.1.1.265, but may also be classified under other alcohol dehydrogenases (specifically, EC 1.1.1.1 or 1.1.1.2).

The substrate to product conversions, and enzymes involved in these reactions, for steps f, g, h, I, j, and k of alternative pathways are described in US 20070092957 A1.

Acetolactate synthase was described above for the 2,3-butanediol pathway. Acetohydroxy acid isomeroreductase, also called ketol-acid reductoisomerase (KARI) naturally uses NADPH (reduced nicotinamide adenine dinucleotide phosphate) as an electron donor and is known by the EC number 1.1.1.86. Sequences of KARI enzymes and their coding regions are provided in US Patent Publication No. US20070092957 A1, including ILV5 from *Saccharomyces cerevisiae* (DNA: SEQ ID NO:117; protein SEQ ID NO:118).

The preferred use in all three pathways of ketol-acid reductoisomerase (KARI) enzymes with particularly high activities are disclosed in US Patent Publication No. US20080261230, which is herein incorporated by reference.

Examples of high activity KARIs disclosed therein are those from *Vibrio cholerae* (DNA: SEQ ID NO:119; protein SEQ ID NO:120), *Pseudomonas aeruginosa* PAO1, (DNA: SEQ ID NO:121; protein SEQ ID NO:122), and *Pseudomonas fluorescens* PF5 (DNA: SEQ ID NO:123; protein SEQ ID NO:124). In addition, mutant KARIs with improved activities are disclosed in US Patent Publication No. US20090163376 and 20100197519, both of which are herein incorporated by reference, including the Pf5.IlvC-Z4B8 mutant *Pseudomonas fluorescens* acetohydroxy acid reductoisomerase (DNA: SEQ ID NO:125; protein SEQ ID NO:126). Another useful KARI is encoded by the ilvC gene of *Lactococcus lactis* (DNA: SEQ ID NO:204; protein SEQ ID NO:205).

Acetohydroxy acid dehydratases, also called dihydroxy acid dehydratases (DHAD), are known by the EC number 4.2.1.9. Sequences of DHAD enzymes and their coding regions are provided in US Patent Publication No. US20070092957 A1, including ILV3 of *Saccharoomyces cerevisiae* (DNA: SEQ ID NO:127; protein SEQ ID NO:128). Additional [2Fe-2S] DHAD sequences and a method for identifying [2Fe-2S] DHAD enzymes that may be used to obtain additional DHAD sequences that may be used are disclosed in US Patent Application Publication No. 20100081154, which is herein incorporated by reference. Particularly useful is the *Streptococcus mutans* DHAD (DNA: SEQ ID NO:129; protein SEQ ID NO:130)

Branched-chain α-keto acid decarboxylases (KivD) are known by the EC number 4.1.1.72. Sequences of the *Lactococcus lactis* branched-chain α-keto acid decarboxylase enzyme and coding region are provided in US20070092957 A1 (DNA: SEQ ID NO:131; protein SEQ ID NO:132), and others may be identified by one skilled in the art using bioinformatics as described above.

Branched-chain alcohol dehydrogenases are known by the EC number 1.1.1.265, but may also be classified under other alcohol dehydrogenases (specifically, EC 1.1.1.1 or 1.1.1.2). These enzymes utilize NADH (reduced nicotinamide adenine dinucleotide) and/or NADPH as electron donor and sequences of branched-chain alcohol dehydrogenase enzymes and their coding regions are provided in US Patent Publication No. US20070092957 A1.

Useful for the last step of converting isobutyraldehyde to isobutanol is a new butanol dehydrogenase isolated from an environmental isolate of a bacterium identified as *Achromobacter xylosoxidans* that is disclosed in US Patent Application Publication No. 20090269823 (DNA: SEQ ID NO:115; protein SEQ ID NO:116), which is herein incorporated by reference. In addition, an alcohol dehydrogenase from horse liver (NADH; codon optimized for expression in *S. cerevisiae*; DNA: SEQ ID NO:136; protein SEQ ID NO:137) as well as others readily identified by one skilled in the art using bioinformatics as described above. Additional alcohol dehydrogenases are described in U.S. Provisional Patent Application No. 61/290,636, incorporated by reference herein.

Genes that may be used for expression of enzymes for two additional isobutanol pathways are described in US Patent Publication No. US20070092957 A1. Additional genes that may be used in all three pathways can be identified by one skilled in the art as described above.

Additionally described in US Patent Publication No. US20070092957 A1 are construction of chimeric genes and genetic engineering of yeast, exemplified by *Saccharomyces cerevisiae*, for isobutanol production using the disclosed biosynthetic pathways. Further description for gene construction and expression is above and in the Examples herein.

A biosynthetic pathway for production of 1-butanol that may be engineered in the present cells is disclosed in US Patent Publication No. US20080182308A1, which is herein incorporated by reference. A diagram of the disclosed 1-butanol biosynthetic pathway is provided in FIG. 4. As described in US US Patent Publication No. US20080182308A1, steps in the disclosed 1-butanol biosynthetic pathway include conversion of:

acetyl-CoA to acetoacetyl-CoA (FIG. 4 pathway step a), as catalyzed for example by acetyl-CoA acetyltransferase;

acetoacetyl-CoA to 3-hydroxybutyryl-CoA (FIG. 4 pathway step b), as catalyzed for example by 3-hydroxybutyryl-CoA dehydrogenase;

3-hydroxybutyryl-CoA to crotonyl-CoA (FIG. 4 pathway step c), as catalyzed for example by crotonase;

crotonyl-CoA to butyryl-CoA (FIG. 4 pathway step d), as catalyzed for example by butyryl-CoA dehydrogenase;

butyryl-CoA to butyraldehyde (FIG. 4 pathway step e), as catalyzed for example by butyraldehyde dehydrogenase; and butyraldehyde to 1-butanol (FIG. 4 pathway step f), as catalyzed for example by butanol dehydrogenase.

Genes that may be used for expression of these enzymes are described in US Patent Publication No. US20080182308A1, and additional genes that may be used can be identified by one skilled in the art as described above. Methods for expression of these genes in yeast are described in US Patent Publication No. US20080182308A1 as well as herein above.

A biosynthetic pathway for production of valine that may be engineered in the present yeast production host cell includes steps of acetolactate conversion to 2,3-dihydroxy-isovalerate by acetohydroxyacid reductoisomerase (ILV5), conversion of 2,3-dihydroxy-isovalerate to 2-keto-isovalerate by dihydroxy-acid dehydratase (ILV3), and conversion of 2-keto-isovalerate to valine by branched-chain amino acid transaminase (BAT2) and branched-chain animo acid aminotransferase (BAT1). Biosynthesis of leucine includes the same steps to 2-keto-isovalerate, followed by conversion of 2-keto-isovalerate to alpha-isopropylmalate by alpha-isopropylmalate synthase (LEU9, LEU4), conversion of alpha-isopropylmalate to beta-isopropylmalate by isopropylmalate isomerase (LEU1), conversion of beta-isopropylmalate to alpha-ketoisocaproate by beta-IPM dehydrogenase (LEU2), and finally conversion of alpha-ketoisocaproate to leucine by branched-chain amino acid transaminase (BAT2) and branched-chain amino acid aminotransferase (BAT1). It is desired for production of valine or leucine to overexpress at least one of the enzymes in these described pathways.

A biosynthetic pathway for production of isoamyl alcohol that may be engineered in the present yeast production host cell includes steps of leucine conversion to alpha-ketoisocaproate by branched-chain amino acid transaminase (BAT2) and branched-chain amino acid aminotransferase (BAT1), conversion of alpha-ketoisocaproate to 3-methylbutanal by ketoisocaproate decarboxylase (THI3) or decarboxylase ARO10, and finally conversion of 3-methylbutanal to isoamyl alcohol by an alcohol dehydrogenase such as ADH1 or SFA1. Production of isoamyl alcohol benefits from increased production of leucine or the alpha-ketoisocaproate intermediate by overexpression of one or more enzymes in biosynthetic pathways for these chemicals. In addition, one or both enzymes for the final two steps may be overexpressed.

A biosynthetic pathway for production of lactic acid that may be engineered in the present yeast production host cell includes pyruvate conversion to lactic acid by lactate dehydrogenase. Engineering yeast for lactic acid production using lactate dehydrogenase, known as EC 1.1.1.27, is well known in the art such as in Ishida et al. (Appl. Environ. Microbiol. 71:1964-70 (2005)).

A biosynthetic pathway for production of malate that may be engineered in the present yeast production host cell includes pyruvate conversion to oxaloacetate by pyruvate carboxylase, and conversion of oxaloacetate to malate by malate dehydrogenase as described in Zelle et al. (Applied and Environmental Microbiology 74:2766-77 (2008)). In addition, a malate transporter was expressed.

Biosynthetic pathways for production of isoprenoids may be engineered in the present yeast production host cell. A mevalonate pathway of yeast (Martin et al (2003) Nature Biotech. 21:796-802) is conversion of pyruvate to acetyl-CoA, which is converted to acetoacetyl-CoA, which is converted to 3-hydroxy-3-methylglutaryl-CoA, which is converted to mevalonate and then to isoprenoids. A non-mevalonate pathway is described in Kim and Keisling (Blotechnol. Bioeng. 72:408-15 (2001)). Isoprenoids may be used in many applications from pharmaceuticals to fuels.

Modifications

Additional modifications that may be useful in cells provided herein include modifications to reduce glycerol-3-phosphate dehydrogenase activity as described in US Patent Application Publication No. 20090305363 (incorporated herein by reference), modifications to a host cell that provide for increased carbon flux through an Entner-Doudoroff Pathway or reducing equivalents balance as described in US Patent Application Publication No. 20100120105 (incorporated herein by reference). Yeast strains with increased activity of heterologous proteins that require binding of an Fe—S cluster for their activity are described in US Application Publication No. 20100081179 (incorporated herein by reference). Other modifications include modifications in an endogenous polynucleotide encoding a polypeptide having dual-role hexokinase activity, described in U.S. Provisional Application No. 61/290,639, integration of at least one polynucleotide encoding a polypeptide that catalyzes a step in a pyruvate-utilizing biosynthetic pathway described in U.S. Provisional Application No. 61/380,563 (both referenced provisional applications are incorporated herein by reference in their entirety).

Additionally, host cells comprising at least one deletion, mutation, and/or substitution in an endogenous gene encoding a polypeptide affecting Fe—S cluster biosynthesis are described in U.S. Provisional Patent Application No. 61/305,333 (incorporated herein by reference), and host cells comprising a heterologous polynucleotide encoding a polypeptide with phosphoketolase activity and host cells comprising a heterologous polynucleotide encoding a polypeptide with phosphotransacetylase activity are described in U.S. Provisional Patent Application No. 61/356,379.

Fermentation Media

Yeasts disclosed herein may be grown in fermentation media for production of a product utilizing pyruvate. For maximal production of some products such as 2,3-butanediol, isobutanol, 2-butanone, or 2-butanol the yeast strains used as production hosts preferably have enhanced tolerance to the produced chemical, and have a high rate of carbohydrate utilization. These characteristics may be conferred by mutagenesis and selection, genetic engineering, or may be natural.

Fermentation media for the present cells contain at least about 2 g/L glucose. Additional carbon substrates may include but are not limited to monosaccharides such as fructose, oligosaccharides such as lactose maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol. Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, preferred carbon substrates are glucose, fructose, and sucrose, or mixtures of these with C5 sugars such as xylose and/or arabinose for yeasts cells modified to use C5 sugars.

In addition to an appropriate carbon source, fermentation media must contain suitable minerals, salts, cofactors, buffers and other components, known to those skilled in the art, suitable for the growth of the cultures and promotion of the enzymatic pathway necessary for production of the desired product.

Culture Conditions

Typically cells are grown at a temperature in the range of about 20° C. to about 37° C. in an appropriate medium. Suitable growth media in the present invention are common commercially prepared media such as broth that includes yeast nitrogen base, ammonium sulfate, and dextrose as the carbon/energy source) or YPD Medium, a blend of peptone, yeast extract, and dextrose in optimal proportions for growing most *Saccharomyces cerevisiae* strains. Other defined or synthetic growth media may also be used and the appropriate medium for growth of the particular microorganism will be known by one skilled in the art of microbiology or fermentation science.

Suitable pH ranges for the fermentation are between pH 3.0 to pH 7.5, where pH 4.5 to pH 6.5 is preferred as the initial condition.

Fermentations may be performed under aerobic or anaerobic conditions, where anaerobic or microaerobic conditions are preferred.

The amount of product in the fermentation medium can be determined using a number of methods known in the art, for example, high performance liquid chromatography (HPLC) or gas chromatography (GC).

Industrial Batch and Continuous Fermentations

The present process may employ a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells progress through a static lag phase to a high growth log phase and finally to a stationary phase where growth rate is diminished or halted. If untreated, cells in the stationary phase will eventually die. Cells in log phase generally are responsible for the bulk of production of end product or intermediate.

A Fed-Batch system may also be used in the present invention. A Fed-Batch system is similar to a typical batch system with the exception that the carbon source substraste is added in increments as the fermentation progresses. Fed-Batch systems are useful when catabolite repression (e.g. glucose repression) is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to vary. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention may be practiced using either batch, fed-batch or continuous processes and that any known mode of fermentation would be suitable. Additionally, it is contemplated that cells may be immobilized on a substrate as whole cell catalysts and subjected to fermentation conditions for production.

Product Isolation from Fermentation Medium

Products may be isolated from the fermenataion medium by methods known to one skilled in the art. For example, butanol may be isolated from the fermentation medium as follows. Solids may be removed from the fermentation medium by centrifugation, filtration, decantation, or the like. Then, the butanol may be isolated from the fermentation medium, which has been treated to remove solids as described above, using methods such as distillation, liquid-liquid extraction, or membrane-based separation. Because butanol forms a low boiling point, azeotropic mixture with water, distillation can only be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see for example Doherty and Malone, *Conceptual Design of Distillation Systems*, McGraw Hill, New York, 2001).

The butanol-water mixture forms a heterogeneous azeotrope so that distillation may be used in combination with decantation to isolate and purify the butanol. In this method, the butanol-containing fermentation broth is distilled to near the azeotropic composition. Then, the azeotropic mixture is condensed, and the butanol is separated from the fermentation medium by decantation. The decanted aqueous phase may be returned to the first distillation column as reflux. The butanol-rich decanted organic phase may be further purified by distillation in a second distillation column.

The butanol may also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption may also be used to isolate butanol from the fermentation medium. In this method, the fermentation broth containing the butanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, J., Fritsch, E. F. and Maniatis, T. *Molecular Cloning: A Laboratory Manual*; Cold Spring Harbor Laboratory Press: Cold Spring Harbor, N.Y. (1989) (Maniatis) and by T. J. Silhavy, M. L. Bennan, and L. W. Enquist, *Experiments with Gene Fusions*, Cold Spring Harbor Laboratory Press, Cold Spring Harbor, N.Y. (1984) and by Ausubel, F. M. et al., *Current Protocols in Molecular Biology*, pub. by Greene Publishing Assoc. and Wiley-Interscience (1987), and by *Methods in Yeast Genetics*, 2005, Cold Spring Harbor Laboratory Press, Cold Spring Harbor, N.Y.

Materials and methods suitable for the maintenance and growth of bacterial cultures are well known in the art. Techniques suitable for use in the following Examples may be found as set out in *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, eds), American Society for Microbiology, Washington, D.C. (1994)) or by Thomas D. Brock in *Biotechnology: A Textbook of Industrial Microbiology*, Second Edition, Sinauer Associates, Inc., Sunderland, Mass. (1989). All reagents, restriction enzymes and materials used for the growth and maintenance of microbial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.) unless otherwise specified. Microbial strains were obtained from The American Type Culture Collection (ATCC), Manassas, Va., unless otherwise noted. The oligonucleotide primers used in the following Examples are given in Table 3. All the oligonucleotide primers were synthesized by Sigma-Genosys (Woodlands, Tex.) or Integrated DNA Technologies (Coralsville, Iowa).

Synthetic complete medium is described in Amberg, Burke and Strathern, 2005, Methods in Yeast Genetics, Cold Spring Harbor Laboratory Press, Cold Spring Harbor, N.Y.

GC Method

The GC method utilized an ZB-WAXplus column (30 m×0.25 mm ID, 0.25 μm film) from Phenomenex (Torrance, Calif.). The carrier gas was helium at a constant flow rate of 2.3 mL/min; injector split was 1:20 at 250° C.; oven temperature was 70° C. for 1 min, 70° C. to 160° C. at 10° C./min, and 160° C. to 240° C. at 30° C./min. FID detection was used at 260° C. with 40 ml/min helium makeup gas. Culture broth samples were filtered through 0.2 μm spin filters before injection. Depending on analytical sensitivity desired, either 0.1 μl or 0.5 μl injection volumes were used. Calibrated standard curves were generated for the following compounds: ethanol, isobutanol, acetoin, meso-2,3-butanediol, and (2S,3S)-2,3-butanediol. (2S,3S)-2,3-butanediol retention time is 6.8 minutes. meso-2,3-butanediol retention time is 7.2 minutes. Analytical standards were also utilized to identify retention times for isobutryaldehyde, isobutyric acid, and isoamyl alcohol.

HPLC Method

Analysis for glucose and fermentation by-product composition is well known to those skilled in the art. For example, one high performance liquid chromatography (HPLC) method utilizes a Shodex SH-1011 column with a Shodex SH-G guard column (both available from Waters Corporation, Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol retention time is 47.6 minutes.

The meaning of abbreviations is as follows: "s" means second(s), "min" means minute(s), "h" means hour(s), "psi" means pounds per square inch, "nm" means nanometers, "d" means day(s), "μL" means microliter(s), "mL" means milliliter(s), "L" means liter(s), "mm" means millimeter(s), "nm" means nanometers, "mM" means millimolar, "M" means molar, "mmol" means millimole(s), "μmol" means micromole(s)", "g" means gram(s), "μg" means microgram(s) and "ng" means nanogram(s), "PCR" means polymerase chain reaction, "OD" means optical density, "$OD_{600}$" means the optical density measured at a wavelength of 600 nm, "kDa" means kilodaltons, "g" means the gravitation constant, "bp" means base pair(s), "kbp" means kilobase pair(s), "% w/v" means weight/volume percent, % v/v" means volume/volume percent, "wt %" means percent by weight, "HPLC" means high performance liquid chromatography, and "GC" means gas chromatography. The term "molar selectivity" is the number of moles of product produced per mole of sugar substrate consumed and is reported as a percent. "SLPM" stands for Standard Liters per Minute (of air), "dO" is dissolved oxygen, Qp is "specific productivity" measured in grams isobutanol per gram of cells over time.

Example 1

Construction of Expression Vectors for Isobutanol Pathway Gene Expression in S. cerevisiae pLH475-Z4B8 Construction The pLH475-Z4B8 plasmid (SEQ ID NO:138) was constructed for expression of ALS and KARI in yeast. pLH475-Z4B8 is a pHR81 vector (ATCC #87541) containing the following chimeric genes:
1) the CUP1 promoter (SEQ ID NO: 139), acetolactate synthase coding region from Bacillus subtilis (AlsS; SEQ ID NO:83; protein SEQ ID NO:84) and CYC1 terminator2 (SEQ ID NO:140);
2) an ILV5 promoter (SEQ ID NO:141), Pf5.IlvC-Z4B8 coding region (SEQ ID NO:125; protein SEQ ID NO:126) and ILV5 terminator (SEQ ID NO:142); and
3) the FBA1 promoter (SEQ ID NO: 143), S. cerevisiae KARI coding region (ILV5; SEQ ID NO: 117; protein SEQ ID NO:118) and CYC1 terminator.

The Pf5.IlvC-Z4B8 coding region is a sequence encoding KARI derived from Pseudomonas fluorescens but containing mutations, that was described in US Patent Application Publication US 2009-0163376 A1, which is herein incorporated by reference. The Pf5.IlvC-Z4B8 encoded KARI (SEQ ID NO:126) has the following amino acid changes as compared to the natural Pseudomonas fluorescens KARI:
C33L: cysteine at position 33 changed to leucine,
R47Y: arginine at position 47 changed to tyrosine,
S50A: serine at position 50 changed to alanine,
T52D: threonine at position 52 changed to asparagine,
V53A: valine at position 53 changed to alanine,
L61F: leucine at position 61 changed to phenylalanine,
T80I: threonine at position 80 changed to isoleucine,
A156V: alanine at position 156 changed to threonine, and
G170A: glycine at position 170 changed to alanine.

The Pf5.IlvC-Z4B8 coding region was was synthesized by DNA 2.0 (Palo Alto, Calif.; SEQ ID NO:125) based on codons that were optimized for expression in Saccharomyces cerevisiae.

Expression Vector pLH468

The pLH468 plasmid (SEQ ID NO:144) was constructed for expression of DHAD, KivD and HADH in yeast.

Coding regions for Lactococcus lactis ketoisovalerate decarboxylase (KivD) and horse liver alcohol dehydrogenase (HADH) were synthesized by DNA2.0 based on codons that were optimized for expression in Saccharomyces cerevisiae (SEQ ID NO:133 and 136, respectively) and provided in plasmids pKivDy-DNA2.0 and pHadhy-DNA2.0. The encoded proteins are SEQ ID NOs:132 and 137, respectively. Individual expression vectors for KivD and HADH were constructed. To assemble pLH467 (pR5426::$P_{TDH3}$-kivDy-TDH3t), vector pNY8 (SEQ ID NO:145; also named pRS426.GPD-ald-GPDt, described in US Patent Pub. No. US2008/0182308, Example 17, which is herein incorporated by reference) was digested with AscI and SfiI enzymes, thus excising the GPD promoter and the ald coding region. A TDH3 promoter fragment (SEQ ID NO:146) from pNY8 was PCR amplified to add an AscI site at the 5' end, and an SpeI site at the 3' end, using 5' primer OT1068 and 3' primer OT1067 (SEQ ID NOs:147 and 148). The AscI/SfiI digested pNY8 vector fragment was ligated with the TDH3 promoter PCR product digested with AscI and SpeI, and the SpeI-SfiI fragment containing the codon optimized kivD coding region isolated from the vector pKivD-DNA2.0. The triple ligation generated vector pLH467 (pRS426::$P_{TDH3}$-kivDy-TDH3t). pLH467 was verified by restriction mapping and sequencing.

pLH435 (pRS425::P$_{GPM1}$-Hadhy-ADH1t) was derived from vector pRS425::GPM-sadB (SEQ ID NO:149) which is described in U.S. Patent App. No. 61/058,970, Example 3, which is herein incorporated by reference. pRS425::GPM-sadB is the pRS425 vector (ATCC #77106) with a chimeric gene containing the GPM1 promoter (SEQ ID NO:150), coding region from a butanol dehydrogenase of *Achromobacter xylosoxidans* (sadB; DNA SEQ ID NO: 115; protein SEQ ID NO:116), and ADH1 terminator (SEQ ID NO:151). pRS425::GPMp-sadB contains BbvI and PacI sites at the 5' and 3' ends of the sadB coding region, respectively. A NheI site was added at the 5' end of the sadB coding region by site-directed mutagenesis using primers OT1074 and OT1075 (SEQ ID NO:152 and 153) to generate vector pRS425-GPMp-sadB-NheI, which was verified by sequencing. pRS425::P$_{GPM1}$-sadB-NheI was digested with NheI and PacI to drop out the sadB coding region, and ligated with the NheI-PacI fragment containing the codon optimized HADH coding region from vector pHadhy-DNA2.0 to create pLH435.

To combine KivD and HADH expression cassettes in a single vector, yeast vector pRS411 (ATCC #87474) was digested with SacI and NotI, and ligated with the SacI-SalI fragment from pLH467 that contains the P$_{TDH3}$-kivDy-TDH3t cassette together with the SalI-NotI fragment from pLH435 that contains the P$_{GPM1}$-Hadhy-ADH1t cassette in a triple ligation reaction. This yielded the vector pRS411::P$_{TDH3}$-kivDy-P$_{GPM1}$-Hadhy (pLH441), which was verified by restriction mapping.

In order to generate a co-expression vector for all three genes in the lower isobutanol pathway: ilvD, kivDy and Hadhy, we used pRS423 FBA ilvD(Strep) (SEQ ID NO:154), which is described in Patent Appln No. 61/100,792, as the source of the IlvD gene. This shuttle vector contains an F1 origin of replication (nt 1423 to 1879) for maintenance in *E. coli* and a 2 micron origin (nt 8082 to 9426) for replication in yeast. The vector has an FBA1 promoter (nt 2111 to 3108; SEQ ID NO:143) and FBA terminator (nt 4861 to 5860; SEQ ID NO:155). In addition, it carries the His marker (nt 504 to 1163) for selection in yeast and ampicillin resistance marker (nt 7092 to 7949) for selection in *E. coli*. The ilvD coding region (nt 3116 to 4828; SEQ ID NO:129; protein SEQ ID NO:130) from *Streptococcus mutans* UA159 (ATCC #700610) is between the FBA promoter and FBA terminator forming a chimeric gene for expression. In addition there is a lumio tag fused to the ilvD coding region (nt 4829-4849).

The first step was to linearize pRS423 FBA ilvD(Strep) (also called pRS423-FBA(SpeI)-IlvD(*Streptococcus mutans*)-Lumio) with SacI and SacII (with SacII site blunt ended using T4 DNA polymerase), to give a vector with total length of 9,482 bp. The second step was to isolate the kivDy-hADHy cassette from pLH441 with SacI and KpnI (with KpnI site blunt ended using T4 DNA polymerase), which gives a 6,063 bp fragment. This fragment was ligated with the 9,482 bp vector fragment from pRS423-FBA(SpeI)-IlvD (*Streptococcus mutans*)-Lumio. This generated vector pLH468 (pRS423::P$_{FBA1}$-ilvD(Strep)Lumio-FBA1t-P$_{TDH3}$-kivDy-TDH3t-P$_{GPM1}$-hadhy-ADH1t), which was confirmed by restriction mapping and sequencing.

Example 2

Pyruvate Decarboxylase and Hexokinase Gene Inactivation

This example describes insertion-inactivation of endogenous PDC1, PDC5, and PDC6 genes of *S. cerevisiae*. PDC1, PDC5, and PDC6 genes encode the three major isozymes of pyruvate decarboxylase. The resulting PDC inactivation strain was used as a host for expression vectors pLH475-Z4B8 and pLH468 that were described in Example 1.

Construction of pdc6::P$_{GPM1}$-sadB Integration Cassette and PDC6 Deletion:

A pdc6::P$_{GPM1}$-sadB-ADH1t-URA3r integration cassette was made by joining the GPM-sadB-ADHt segment (SEQ ID NO:156) from pRS425::GPM-sadB (described above) to the URA3r gene from pUC19-URA3r. pUC19-URA3r (SEQ ID NO:157) contains the URA3 marker from pRS426 (ATCC #77107) flanked by 75 bp homologous repeat sequences to allow homologous recombination in vivo and removal of the URA3 marker. The two DNA segments were joined by SOE PCR (as described by Horton et al. (1989) Gene 77:61-68) using as template pRS425::GPM-sadB and pUC19-URA3r plasmid DNAs, with Phusion DNA polymerase (New England Biolabs Inc., Beverly, Mass.; catalog no. F-5405) and primers 114117-11A through 114117-11D (SEQ ID NOs:158, 159, 160 and 161), and 114117-13A and 114117-13B (SEQ ID NOs:162 and 163).

The outer primers for the SOE PCR (114117-13A and 114117-13B) contained 5' and 3' ~50 bp regions homologous to regions upstream and downstream of the PDC6 promoter and terminator, respectively. The completed cassette PCR fragment was transformed into BY4700 (ATCC #200866) and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 112590-34G and 112590-34H (SEQ ID NOs:164 and 165), and 112590-34F and 112590-49E (SEQ ID NOs: 166 and 167) to verify integration at the PDC6 locus with deletion of the PDC6 coding region. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain has the genotype: BY4700 pdc6::P$_{GPM1}$-sadB-ADH1t.

Construction of dc1::P$_{PDC1}$-ilvD Integration Cassette and PDC1 Deletion:

A pdc1::P$_{PDC1}$-ilvD-FBA1t-URA3r integration cassette was made by joining the ilvD-FBA1t segment (SEQ ID NO:168) from pLH468 (described above) to the URA3r gene from pUC19-URA3r by SOE PCR (as described by Horton et al. (1989) Gene 77:61-68) using as template pLH468 and pUC19-URA3r plasmid DNAs, with Phusion DNA polymerase (New England Biolabs Inc., Beverly, Mass.; catalog no. F-5405) and primers 114117-27A through 114117-27D (SEQ ID NOs:169, 170, 171 and 172).

The outer primers for the SOE PCR (114117-27A and 114117-27D) contained 5' and 3' ~50 bp regions homologous to regions downstream of the PDC1 promoter and downstream of the PDC1 coding sequence. The completed cassette PCR fragment was transformed into BY4700 pdc6::P$_{GPM1}$-sadB-ADH1t and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 114117-36D and 135 (SEQ ID NOs 173 and 174), and primers 112590-49E and 112590-30F (SEQ ID NOs 167 and 175) to verify integration at the PDC1 locus with deletion of the PDC1 coding sequence. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain "NYLA67" has the genotype: BY4700 pdc6::$P_{GPM1}$-sadB-ADH1t pdc1:: $P_{PDC1}$-ilvD-FBA1t.

HIS3 Deletion

To delete the endogenous HIS3 coding region, a his3::URA3r2 cassette was PCR-amplified from URA3r2 template DNA (SEQ ID NO:176). URA3r2 contains the URA3 marker from pRS426 (ATCC #77107) flanked by 500 bp homologous repeat sequences to allow homologous recombination in vivo and removal of the URA3 marker. PCR was done using Phusion DNA polymerase and primers 114117-45A and 114117-45B (SEQ ID NOs:177 and 178) which generated a ~2.3 kb PCR product. The HIS3 portion of each primer was derived from the 5' region upstream of the HIS3 promoter and 3' region downstream of the coding region such that integration of the URA3r2 marker results in replacement of the HIS3 coding region. The PCR product was transformed into NYLA67 using standard genetic techniques (*Methods in Yeast Genetics,* 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened to verify correct integration by replica plating of transformants onto synthetic complete media lacking histidine and supplemented with 2% glucose at 30° C. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain, called NYLA73, has the genotype: BY4700 pdc6::$P_{GPM1}$-sadB-ADH1t pdc1::$P_{PDC1}$-ilvD-FBA1t Δhis3.

Construction of pdc5::kanMX Integration Cassette and PDC5 Deletion:

A pdc5::kanMX4 cassette was PCR-amplified from strain YLR134W chromosomal DNA (ATCC No. 4034091) using Phusion DNA polymerase and primers PDC5::KanMXF and PDC5::KanMXR (SEQ ID NOs:179 and 180) which generated a ~2.2 kb PCR product. The PDC5 portion of each primer was derived from the 5' region upstream of the PDC5 promoter and 3' region downstream of the coding region such that integration of the kanMX4 marker results in replacement of the PDC5 coding region. The PCR product was transformed into NYLA73 using standard genetic techniques (*Methods in Yeast Genetics,* 2005, Cold Spring Harbor Laboratory Press, Cold Spring Harbor, N.Y., pp. 201-202) and transformants were selected on YP media supplemented with 1% ethanol and geneticin (200 μg/ml) at 30° C. Transformants were screened by PCR to verify correct integration at the PDC locus with replacement of the PDC5 coding region using primers PDC5kofor and N175 (SEQ ID NOs: 181 and 182). The identified correct transformants have the genotype: BY4700 pdc6::$P_{GPM1}$-sadB-ADH1t pdc1::$P_{PDC1}$-ilvD-FBA1t Δhis3 pdc5::kanMX4. The strain was named NYLA74.

Deletion of HXK2 (Hexokinase II):

A hxk2::URA3r cassette was PCR-amplified from URA3r2 template (described above) using Phusion DNA polymerase and primers 384 and 385 (SEQ ID NOs:183 and 184) which generated a ~2.3 kb PCR product. The HXK2 portion of each primer was derived from the 5' region upstream of the HXK2 promoter and 3' region downstream of the coding region such that integration of the URA3r2 marker results in replacement of the HXK2 coding region. The PCR product was transformed into NYLA73 using standard genetic techniques (*Methods in Yeast Genetics,* 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the HXK2 locus with replacement of the HXK2 coding region using primers N869 and N871 (SEQ ID NOs:185 and 186). The URA3r2 marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth, and by PCR to verify correct marker removal using primers N946 and N947 (SEQ ID NOs:187 and 188). The resulting identified strain named NYLA83 has the genotype: BY4700 pdc6::$P_{GPM1}$-sadB-ADH1t pdc1::$P_{PDC1}$-ilvD-FBA1t Δhis3 Δhxk2.

Construction of pdc5::kanMX Integration Cassette and PDC5 Deletion

A pdc5::kanMX4 cassette was PCR-amplified as described above. The PCR fragment was transformed into NYLA83, and transformants were selected and screened as described above. The identified correct transformants named NYLA84 have the genotype: BY4700 pdc6::$P_{GPM1}$-sadB-ADH1t pdc1::$P_{PDC1}$-ilvD-FBA1t Δhis3 Δhxk2 pdc5::kanMX4.

Plasmid vectors pLH468 and pLH475-Z4B8 were simultaneously transformed into strain NYLA84 (BY4700 pdc6::$P_{GPM1}$-sadB-ADH1t pdc1::$P_{PDC1}$-ilvD-FBA1t Δhis3 Δhxk2 pdc5::kanMX4) using standard genetic techniques (*Methods in Yeast Genetics,* 2005, Cold Spring Harbor Laboratory Press, Cold Spring Harbor, N.Y.) and the resulting strain was maintained on synthetic complete media lacking histidine and uracil, and supplemented with 1% ethanol at 30° C.

Example 3

Vector Construction for the Production of Butanediol

The purpose of this example is to describe the construction of vectors for the expression of acetolactate decarboxylase, butanediol dehydrogenase, and, optionally, acetolactate synthase and/or secondary alcohol dehydrogenase activity in the cytosol of yeast.

Construction of pRS423::CUP1-alsS+FBA-budA

The budA gene, encoding acetolactate decarboxylase, was amplified from genomic DNA prepared from *Klebsiella pneumonia* (ATCC #25955) using Phusion™ Hot Start High-Fidelity DNA Polymerase (New England Biolabs, Inc.). The primers used (N579 and N580, provided as SEQ ID NOs:189 and 190) added sequence upstream of the start codon that was homologous to the yeast FBA1 promoter and sequence downstream of the stop codon that was homologous to the yeast ADH1 terminator. Plasmid pRS423::CUP1-alsS+FBA-ILV3, which has a chimeric gene containing the CUP1 promoter (SEQ ID NO:139), alsS coding region from *Bacillus subtilis* (SEQ ID NO:83), and CYC1 terminator (SEQ ID NO:203) as well as a chimeric gene containing the FBA promoter (SEQ ID NO:143), ILV3 coding region from *S. cerevisiae* (SEQ ID NO:127), and ADH1 terminator (SEQ ID NO:151) (described in US Patent Publication No. US20070092957 A1, Example 17) was restriction digested with NcoI and PmlI to remove the ILV3 coding region. The 11.1 kb vector band was gel purified. Approximately 1 μg of cut vector DNA was combined with 1 μg of the budA PCR product and transformed into *S. cerevisiae* strain BY4741.

The insert and vector were combined by homologous recombination in vivo to form a circular vector (also known as "gap repair cloning"; described in Ma et al. (1987) Genetics 58:201-216) that allows retention of the selectable marker (in this case, HIS3). Transformants were selected on synthetic complete medium lacking histidine. Colonies were patched to a new plate and cells from these patches were used to prepare plasmid DNA (Zymoprep™ Yeast Plasmid Miniprep Kit, Zymo Research). PCR was used to screen plasmids for the presence of alsS (primers N98SeqF1 and N99SeqR2, SEQ ID NOs: 191 and 192) and for proper insertion of budA (N160SeqF1 and N84SeqR2, SEQ ID NOs:193 and 194).
Construction of pRS426::FBA-budC The budC coding region for butanediol dehydrogenase was amplified from genomic DNA prepared from *Klebsiella pneumonia* (ATCC #25955) using Phusion™ Hot Start High-Fidelity DNA Polymerase (New England Biolabs, Inc.). The primers used (N581 and N582, provided as SEQ ID NOs:195 and 196) added sequence upstream of the start codon that was homologous to the yeast FBA1 promoter and sequence downstream of the stop codon that was homologous to the yeast CYC1 terminator. The plasmid pRS426::FBA::alsS (described in Example 2, also called pRS426-FBAp-alsS) was digested with BbvCI and PacI to release an alsS fragment. The remaining linear vector was gel purified. Approximately 1 μg of vector was combined with 1 μg of budC PCR product and transformed into BY4741 to obtained gap repair clones (see above). Transformants were selected on synthetic complete medium lacking uracil. Plasmids were prepared from patches of 5 transformant colonies. The presence of FBA-budC was screened using PCR with primers N160SeqF1 and N582 (SEQ ID NOs:193 and 196).
Construction of pRS423::FBA-budC+FBA-budA The pRS423::CUP1-alsS+FBA-budA vector described above was digested with SacII and MluI to remove CUP1-alsS. SacII/MluI digestion was also used to isolate FBA1-budC from pRS426::FBA-budC (see above). The appropriate fragments (7.6 kb vector fragment and 1.6 kb FBA-budC fragment) were gel purified, ligated and transformed into *E. coli* TOP10 competent cells (Invitrogen). Transformant colonies were screened by PCR to confirm incorporation of the budC fragment using primers N581 and N582 (SEQ ID NOs: 195 and 1196).
Construction of pRS425::GPM-sadB A DNA fragment encoding a butanol dehydrogenase (protein of SEQ ID NO:116) from *Achromobacter xylosoxidans* (disclosed in US Patent Application Publication 20090269823) was cloned. The coding region of this gene called sadB for secondary alcohol dehydrogenase (SEQ ID NO:115) was amplified using standard conditions from *A. xylosoxidans* genomic DNA, prepared using a Gentra Puregene kit (Gentra Systems, Inc., Minneapolis, Minn.; catalog number D-5500A) following the recommended protocol for gram negative organisms using forward and reverse primers N473 and N469 (SEQ ID NOs:197 and 198), respectively. The PCR product was TOPO-Blunt cloned into pCR4 BLUNT (Invitrogen) to produce pCR4Blunt::sadB, which was transformed into *E. coli* Mach-1 cells. Plasmid was subsequently isolated from four clones, and the sequence verified.

The sadB coding region was PCR amplified from pCR4Blunt::sadB. PCR primers contained additional 5′ sequences that would overlap with the yeast GPM1 promoter and the ADH1 terminator (N583 and N584, provided as SEQ ID NOs:199 and 200). The PCR product was then cloned using "gap repair" methodology in *Saccharomyces cerevisiae* (Ma et al. ibid) as follows. The yeast-*E. coli* shuttle vector pRS425::GPM::kivD::ADH which contains the GPM1 promoter (SEQ ID NO:150), kivD coding region from *Lactococcus lactis* (SEQ D NO:131), and ADH1 terminator (SEQ ID NO:151) (described in US Patent Publication No. US20070092957 A1, Example 17) was digested with BbvCI and PacI restriction enzymes to release the kivD coding region. Approximately 1 μg of the remaining vector fragment was transformed into *S. cerevisiae* strain BY4741 along with 1 μg of sadB PCR product. Transformants were selected on synthetic complete medium lacking leucine. The proper recombination event, generating pRS425::GPM-sadB, was confirmed by PCR using primers N142 and N459 (SEQ ID NOs:201 and 202).
Construction of pRS426::FBA-budC+GPM-sadB The GPM-sadB-ADH promoter-gene-terminator cassette was transferred to pRS426 (ATCC No. 77107), a yeast-*E. coli* shuttle vector carrying the URA3 selection marker, by gap repair cloning. The cassette was isolated from pRS425::GPM-sadB by digestion with SalI and SacII, and the pRS426 vector was linearized with BamHI prior to ligation. The resulting vector, pRS426::GPM-sadB was confirmed by PCR using primers N142 and N459 (SEQ ID NOs:191 and 192). In order to add the budC gene encoding acetoin reductase from *Klebsiella pneumonia* to this vector, a fragment containing budC was excised from pRS423::FBA-budC+FBA-budA using SphI and SapI.

For construction of pRS423::FBA-budC+FBA-budA, the pRS423::CUP1-alsS+FBA-budA vector described above was digested with SacII and MluI to remove CUP1-alsS. SacII/MluI digestion was also used to isolate FBA-budC from pRS426::FBA-budC (described above). The appropriate fragments (7.6 kb vector fragment and 1.6 kb FBA-budC fragment) were gel purified, ligated and transformed into *E. coli* TOP10 competent cells (Invitrogen). Transformant colonies were screened by PCR to confirm incorporation of the budC fragment using primers N581 and N582 (SEQ ID NOs: 185 and 186).

The SphI-SapI budC fragment from pRS423::FBA-budC+FBA-budA carries portions of the vector upstream of the FBA1 promoter as well as part of the ADH1 terminator to allow for cloning by gap repair cloning into the pRS426::GPM-sadB vector that was linearized with SacII. Transformants resulting from this cloning were plated on medium lacking uracil to select for recombination of the two linear sequences. The resulting vector, pRS426::FBA-budC+GPM-sadB was confirmed by PCR using primers N581 and N582 (SEQ ID NOs:1185 and 186).

Example 4

Production of Butanediol in pdc−, HXK2⁻ Yeast

The purpose of this example is to describe the production of butanediol (BDO) in the yeast strain NYLA84. The yeast strain comprises deletions of PDC1, PDC5, and PDC6, genes encoding three isozymes of pyruvate decarboxylase, and constructs for heterologous expression of AlsS (acetolactate synthase), BudA (acetolactate decarboxylase), BudC (butanediol dehydrogenase), and SadB (secondary alcohol dehydrogenase). SadB is not a part of the BDO pathway, is not necessary, and is included due to its presence in pRS426::FBA-budC+GPM-sadB used for expression of BudC.
Strain Construction Plasmids pRS423::CUP1-alsS+FBA-budA and pRS426::FBA-budC+GPM-sadB, described in Example 3 above, were introduced into NYLA74 or NYLA84, described in Example 2, by standard PEG/lithium acetate-mediated transformation methods. Transformants were selected on synthetic complete medium lacking glucose, histidine and uracil. Ethanol (1% v/v) was used as the carbon source. After three days, transformants were patched to synthetic complete medium lacking histidine and uracil, supplemented with both 2% glucose and 1% ethanol as carbon sources. The resulting strains were named NYLA74BDO and NYLA84BDO.

Production of Butanediol in Shake Flasks

The butanediol pathway-containing NYLA74 and NYLA84 strains were inoculated into 20 ml culture medium in 125-ml sealed flasks with agitation (225 rpm) at 30° C. Culture medium was synthetic complete medium without uracil or histidine, supplemented with 2% glucose and 0.5% (v/v) ethanol. Flasks were incubated at 30° C. with agitation. After 48 hours, filtered culture medium was analyzed by HPLC and GC as described in General Methods. Results of growth, glucose consumption and BDO production are given in Table 4.

TABLE 4

Growth, glucose consumption and BDO production in butanediol pathway-containing pdc-strains with and without Hxk2 deletion.

| Strain | OD | Glucose consumed | BDO Titer (g/L) | BDO Y molar yield | BDO Y (g BDO/g glucose) |
|---|---|---|---|---|---|
| NYLA74BDO | 0.96 | 100% | 6.37 | 0.64 | 0.32 |
| NYLA84BDO | 4.6 | 99% | 7.48 | 0.72 | 0.36 |

Data are averages of duplicate (NYLA74BDO) or quadruplicate (NYLA84BDO) experiments.
Butanediol (BDO) refers to the sum of meso-2,3-butanediol, (2S,3S)-(+)-2,3-butanediol and (2R,3R)-(−)-2,3-butanediol isomers.
The NYLA84BDO strain containing the HXK2 deletion demonstrated better growth, and produced higher titers and yields of butanediol than the NYLA74BDO strain without the HXK2 deletion.

Example 5

Comparison of Cell Growth for NYLA84 (Δhxk2 Δpdc) and NYLA74 (Δpdc) Strain Backgrounds The purpose of this example is to describe the enhanced growth of the yeast strain NYLA84 when supplemented with the isobutanol production pathway. The NYLA74 strain and NYLA84 yeast strains both contained deletions of PDC1, PDC5, and PDC6, genes encoding three isozymes of pyruvate decarboxylase. NYLA84 also contained the deletion in hexokinase II. All strains contain plasmid and chromosomal constructs for heterologous expression of AlsS (acetolactate synthase), ILV5/IlvC (keto acid reductoisomerase), IlvD (dihydroxyacid dehydratase), KivD (keto-isovalerate decarboxylase), and hADH1 (horse liver alcohol dehydrogenase).

Strain Construction

Plasmids pLH468 and pLH475-Z4B8, described in Example 1, were introduced into NYLA74 or NYLA84, described in Example 2, by standard PEG/lithium acetate-mediated transformation methods. Transformants were selected on synthetic complete medium lacking glucose, histidine and uracil and supplemented with ethanol (1% v/v) as the carbon source. After three days, transformants were patched to synthetic complete medium lacking histidine and uracil supplemented with both 2% glucose and 1% ethanol as carbon sources.

The isobutanol pathway-containing NYLA74 and NYLA84 strains were inoculated into 20 ml culture medium in 125-ml sealed flasks with agitation (225 rpm) at 30° C. Culture medium was synthetic complete medium without uracil or histidine, supplemented with 2% glucose and 0.5% (v/v) ethanol. Flasks were incubated at 30° C. with agitation. Cell growth was monitored by removal of samples at periodic intervals and measured by spectrophotometric assay (OD600). Five separate cultures were assayed for the NYLA84 strain and 2 for the NYLA74 strain. Results are shown in FIG. 5. In excess glucose conditions (20 g/L), the hexokinase2 deletion NYLA84-based strain showed dramatic growth advantages compared to the NYLA74-based strain.

Example 6

Production of Isobutanol

The purpose of this example is to describe the production of isobutanol in the yeast strain NYLA84. The yeast strain comprises deletions of PDC1, PDC5, and PDC6, genes encoding three isozymes of pyruvate decarboxylase, and constructs for heterologous expression of AlsS (acetolactate synthase), KARI (keto acid reductoisomerase), DHAD (dihydroxy acid dehydratase), KivD (ketoisovalerate decarboxylase), and SadB (secondary alcohol dehydrogenase).

Strain Construction

Plasmids pLH468 and pLH475-Z4B8 were introduced into NYLA74 or NYLA84, described in Example 2, by standard PEG/lithium acetate-mediated transformation methods. Transformants were selected on synthetic complete medium lacking glucose, histidine and uracil. Ethanol (1% v/v) was used as the carbon source. After three days, transformants were patched to synthetic complete medium lacking histidine and uracil supplemented with both 2% glucose and 1% ethanol as carbon sources. Fermentation seed vials were made by inoculation of cultures into synthetic complete medium lacking histidine and uracil supplemented with both 0.2% glucose and 0.5% ethanol. Glycerol was added to final concentration of 15% (v/v) and vials were stored at −80° C.

Production of Isobutanol

Fermentation inoculum was grown in synthetic complete medium lacking histidine and uracil supplemented with 1% ethanol as a carbon source at 30° C. and shaking at 250 rpm. Inoculation volume for the fermenters was 80 ml. The 80 ml of inoculum in the 800 ml fermentation medium described below resulted in the presence of 0.1% ethanol.

The NYLA84/pLH468+pLH475-Z4B8 strain fermenter was prepared and sterilized with 0.4 L water. After cooling, filter sterilized media was added to give the following final concentrations in 800 mL post-inoculation:

Medium (Final Concentration):
 6.7 g/L Yeast Nitrogen Base w/o amino acids (Difco)
 2.8 g/L Yeast Synthetic Drop-out Medium Supplement Without Histidine, Leucine, Tryptophan and Uracil (Sigma Y2001)
 20 mL/L of 1% (w/v) L-Leucine
 4 mL/L of 1% (w/v) L-Tryptophan
 10 g/L glucose
 1 mL/L 1% ergosterol in 50% (v/v) Tween-80/ethanol solution
 0.2 mL/L Sigma DF204 antifoam The fermenter was set to control at pH 5.5 with KOH, inital dO (dissolved oxygen) 30% by stirring, temperature 30° C., and airflow of 0.2 SLPM (or, 0.25 vvm). At inoculation, the airflow was set to 0.01 SLPM initially, then increased to 0.2 SLPM. Glucose was maintained at 5-15 g/L throughout.

The NYLA74/pLH468+pLH475-Z4B8 strain fermenter was prepared as for the NYLA84/pLH468+pLH475-Z4B8 strain fermenter except that 1 mL/L ergosterol/tween/ethanol solution and 0.2 mL/L Sigma DF204 antifoam were omitted, and glucose was 2 g/L. Initial ethanol concentration in the fermenter was 0.1%.

The fermenter was set to control at pH 5.5 with KOH, inital dO 30% by stirring, temperature 30° C., and airflow of 0.2 SLPM (or, 0.25 vvm). At inoculation, the airflow was set to 0.01 SLPM initially, then increased to 0.2 SLPM. Glucose was maintained at 0.1-2 g/L throughout.

Samples were taken periodically and measured for growth by OD600, and for isobutanol content by HPLC as described in General Methods. FIG. 6 shows the results comparing strains with and without hexokinase deletion for growth (6A) and isobutanol production (6B). FIG. 7 shows a comparison of growth and isobutanol production for the HXK2$^+$ strain (7A) and the HXK2$^-$ strain (7B). FIG. 8 plots the results as "specific productivity" (Qp) measured in grams isobutanol per gram of cells over time. For the HXK2$^+$ strain, the cell specific productivity dropped from 60-90 hours when there was no longer growth, while for HXK2$^-$ strain, the specific productivity was relatively well maintained from 60-140 hours showing that the strain is capable of better non-growth associated production.

Example 7

Isobutanol Production Using *L. lactis* ilvC

Vector Construction for Expressing ilvC from *L. lactis*

As shown in Examples 1 and 6, co-expression of two KARI genes, ILV5 from *S. cerevisiaae* and IlvC from *P. fluorescence* PF-5, was effective in the pathway for isobutanol production. In this example, the combination of *S. cerevisiae* ILV5 and ilvC from *Lactococcus lactis* subsp *lactis* NCDO2118 (NCIMB 702118) (Godon et al., J. Bacteriol. (1992) 174: 6580-6589) was used in the isobutanol pathway.

The *L. lactis* ilvC coding region (SEQ ID NO:204; protein SEQ ID NO:205) was amplified with primer set IlvC(*Lactis*)-F and IlvC(*Lactis*)-R (SEQ ID NOs:206, 207) using as template a vector (pDM5-PldhL1-ilvC (*L. lactis*); SEQ ID NO:208) containing the *L. lactis* ilvC coding region that had been amplified from the genomic DNA of *Lactococcus lactis* subsp *lactis* as described in U.S. Provisional Patent Application No. 61/246,717, which is herein incorporated by reference. The PCR product was digested with AvrII and SfiI and cloned into corresponding sites of a pLH475-based vector creating the construct pLH475-IlvC (*L. lactis*) (SEQ ID NO:209), which is the same as pLH475-Z4B8 described in Example 1 except that the Pf5.IlvC-Z4B8 coding region was replaced with the *L. lactis* ilvC coding region.

Isobutanol Strain and Production

The expression construct pLH475-IlvC (*L. lactis*) constructed above was transformed into strains NYLA84 and NYLA74 (described in Example 2) along with vector pLH468 (described in Example 1). The transformation procedure was the same as described in Example 6. Transformants were then patched onto yeast culture plates that contained yeast drop-out medium (without histidine and uracil). The medium was supplemented with 2% glucose and 0.1% ethanol. After adaptation on glucose plates, the yeast strains were initially inoculated in tubes containing 5 ml medium and then transferred to flasks for isobutanol production. For the flask experiment, the same drop-out medium supplemented with 2% glucose and 0.1% ethanol was used. Flasks with 20 ml medium were inoculated with a fresh starting culture from tubes to an OD600 of 0.2 to 0.3. The flask lids were closed and flasks were incubated in a 30° C. shaker with a constant speed of 215 rpm. Samples were taken for HPLC analysis at different times and results for the NYLA84/pLH468+pLH475-ilvC (*L. lactis*) strain are shown in Table 5. The strain grew on 2% glucose medium and produced a significant amount of isobutanol. However the NYLA74/pLH468+pLH475-ilvC (*L. lactis*) strain showed poor growth on 2% glucose liquid medium after being transferred from glucose plates. After 72 hours the OD600 average for 3 samples was 0.272. Due to this poor growth, isobutanol was not assayed for these cultures.

The results showed that the HXK2 negative strain was a better host than the HXK2 positive strain for isobutanol production when two KARI genes, ILV5 from *S. cerevisiae* and IlvC from *L. lactis*, were co-expressed.

TABLE 5

Isobutanol production by NYLA84 strain containing vectors MpLH475-IlvC (*L. lactis*) and pLH468

| Time (hours) | OD at 600 nm | Titer (g/L) | Yield (g/g of glucose) |
| --- | --- | --- | --- |
| 24 | 1.2 | 1.3 | 0.23 |
| 48 | 2.7 | 3.4 | 0.26 |
| 72 | 2.8 | 4.8 | 0.26 |

Example 8

Construction of a Strain Comprising Hxk2 Deletion and an Isobutanol Biosynthetic Pathway Construction of NYLA93

Described below is insertion-inactivation of endogenous GPD2 and PDC5 genes of *S. cerevisiae*. The resulting PDC inactivation strain was used as a host for expression vectors pYZ067 (SEQ ID NO: 220) and pYZ090 (SEQ ID NO: 221), described in U.S. Patent Application No. 61/246,844, filed Sep. 29, 2009, herein incorporated by reference.

Deletion of NAD-Dependent Glycerol 3-Phosphate Dehydrogenase:

A gpd2::loxP-URA3-loxP cassette was PCR-amplified from pUC19::loxP-URA3-loxP plasmid template using Phusion DNA polymerase and primers LA512 and LA513 (SEQ ID NOs: 210 and 211) which generated a ~1.6 kb PCR product. pUC19::loxP-URA3-loxP (SEQ ID NO: 212) contains the URA3 marker from (ATCC #77107) flanked by loxP recombinase sites. The GPD2 portion of each primer was derived from the 5' region upstream of the GPD2 promoter and 3' region downstream of the coding region such that integration of the loxP-URA3-loxP marker results in replacement of the GPD2 coding region. The PCR product was transformed into NYLA83 using standard genetic techniques (Methods in Yeast Genetics, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the GPD2 locus with replacement of the HXK2 coding region using primers LA516 and N175 (SEQ ID NO: 214 and 177). The URA3 marker is recycled by transformation with pRS423::PGAL1-cre (SEQ ID NO: 213) and plating on synthetic complete media lacking histidine supplemented with 2% glucose at 30° C. Colonies are patched onto YP (1% galactose) plates at 30° C. to induce URA3 marker excision and are transferred onto YPD plates at 30° C. for recovery. Removal of the URA3 marker is confirmed by patching colonies from the YPD plates onto synthetic complete media lacking uracil to verify the absence of growth.

The identified correct clones have the genotype: BY4700 pdc6:: P$_{GPM1}$-sadB-ADH1t pdc1::P$_{PDC1}$-ilvD-FBA1t Δhis3 Δhxk2 Δgpd2::loxP. The strain was named NYLA92.

Construction of pdc5::loxP-kanMX-loxP Integration Cassette and PDC5 Deletion:

A pdc5::loxP-kanMX-loxP cassette was PCR-amplified from plasmid pUC19::loxP-kanMX-loxP (SEQ ID NO: 217) using Phusion DNA polymerase and primers LA249 and LA397 (SEQ ID NOs: 218 and 219) which generated a ~2.2 kb PCR product. pUC19::loxP-kanMX-loxP (SEQ ID NO: 217) contains the kanMX gene from pFA6 (Wach, A., et al. (1994). New heterologous modules for classical or PCR-based gene disruptions in Saccharomyces cerevisiae, Yeast 10, 1793-1808) and K. lactis TEF1 promoter and terminator flanked by loxP recombinase sites. The PDC5 portion of each primer was derived from the 5' region upstream of the PDC5 promoter and 3' region downstream of the coding region such that integration of the loxP-kanMX-loxP marker results in replacement of the PDC5 coding region. The PCR product was transformed into NYLA92 using standard genetic techniques (Methods in Yeast Genetics, 2005, Cold Spring Harbor Laboratory Press, Cold Spring Harbor, N.Y., pp. 201-202) and transformants were selected on YP media supplemented with 1% ethanol and geneticin (200 µg/ml) at 30° C. Transformants were screened by PCR to verify correct integration at the PDC5 locus with replacement of the PDC5 coding region using primers LA363 and LA364 (SEQ ID NOs: 215 and 216). The identified correct transformants have the genotype: BY4700 pdc6::P$_{GPM1}$-sadB-ADH1t pdc1::P$_{PDC1}$-ilvD-FBA1t Δhis3 Δhxk2 Δgpd2::loxP Δpdc5:loxP-kanMX-loxP. The strain was named NYLA93.

pYZ090 and pYZ067 pYZ090 (SEQ ID NO: 221) was constructed to contain a chimeric gene having the coding region of the alsS gene from Bacillus subtilis (nt position 457-2172) expressed from the yeast CUP1 promoter (nt 2-449) and followed by the CYC1 terminator (nt 2181-2430) for expression of ALS, and a chimeric gene having the coding region of the ilvC gene from Lactococcus lactis (nt 3634-4656) expressed from the yeast ILV5 promoter (2433-3626) and followed by the ILV5 terminator (nt 4682-5304) for expression of KARI.

pYZ067 (SEQ ID NO: 220) was constructed to contain the following chimeric genes: 1) the coding region of the ilvD gene from S. mutans UA159 with a C-terminal Lumio tag (nt position 2260-3996) expressed from the yeast FBA1 promoter (nt 1161-2250) followed by the FBA1 terminator (nt 4005-4317) for expression of dihydroxy acid dehydratase (DHAD), 2) the coding region for horse liver ADH (nt 4680-5807) expressed from the yeast GPM1 promoter (nt 5819-6575) followed by the ADH1 terminator (nt 4356-4671) for expression of alcohol dehydrogenase, and 3) the coding region of the KivD gene from Lactococcus lactis (nt 7175-8821) expressed from the yeast TDH3 promoter (nt 8830-9493) followed by the TDH3 terminator (nt 6582-7161) for expression of ketoisovalerate decarboxylase.

NYLA93 (pYZ067/pYZ090)

Plasmid vectors pYZ067 and pYZ090 were simultaneously transformed into strain NYLA93 (BY4700 pdc6:: P$_{GPM1}$-sadB-ADH1t pdc1:: P$_{PDC1}$-ilvD-FBA1t Δhis3 Δhxk2 Δgpd2::loxP Δpdc5:loxP-kanMX-loxP) using standard genetic techniques (Methods in Yeast Genetics, 2005, Cold Spring Harbor Laboratory Press, Cold Spring Harbor, N.Y.) and the resulting strain was maintained on synthetic complete media lacking histidine and uracil, and supplemented with 1% ethanol at 30° C.

SEQUENCE LISTING (221 sequences)

SEQ ID NO: 1 - DNA, 4506 bp, Saccharomyces cerevisiae
atgtcgaataccccttataattcatctgtgccttccattgcatccatgacccagtcttcggtctcaagaagtcctaacatgcatacagcaactacgcccggtgccaacaccagctctaactctccacccttgcacatgtcttcagattcgtccaagatcaagaggaagcgtaacagaattccgctcagttgcaccatttgtcggaaaaggaaagtcaaatgtgacaaactcagaccacactgccagcagtgcactaaaactggggtagcccatctctgccactacatggaacagacctgggcagaagaggcagagaaagaattgctgaaggacaacgaattaaagaagcttagggagcgcgtaaaatctttagaaaagactctttctaaggtgcactcttctccttcgtctaactccttgaaaagttacaacactcccgagagcagcaacctgtttatgggtagcgatgaacacaccacccttgttaatgcaaatacaggctctgcttcctctgcctcgcatatgcatcagcaacaacagcaacagcagcaacaggaacaacaacaagacttttccagaagtgcgaacgccaacgcgaattcctcgtccctttctatctcaaataaatatgacaacgatgagctggacttaactaaggactttgatcttttgcatatcaaaagtaacggaaccatccacttaggtgccacccactggttgtctatcatgaaaggtgacccgtacctaaaacttttgtggggtcatatcttcgctatgagggaaaagttaaatgaatggtactaccaaaaaaattcgtactctaagctgaagtcaagcaaatgtcccatcaatcacgcgcaagcgccgccttctgccgctgccgccgctaccagaaaatgtcctgttgatcactccgcgttttcgtctggcatggtggccccaaaggaggagactcctcttcctaggaaatgtccagttgaccacaccatgttctcttcgggaatgattcctcccagagaggacacttcgtcccagaagaggtgtcccgttgaccacaccatgtattccgcaggaatgatgccgcccaaggacgagacaccttccccattttccactaaagctatgatagaccataacaagcatacaatgaatccgcctcagtcaaaatgtcctgtggaccatagaaactatatgaaggattatccctctgacatggcaaattcttcttcgaacccggcaagtcgttgccccattgaccattcaagcatgaaaaatacagcggccttaccagcttcaacgcacaataccatcccacaccaccaaccacagtccggatctcatgctcgttcgcatcccgcacaaagcaggaaacatgattcctacatgacagaatctgaagtcctcgcaacactttgtgagatgttgccaccaaagcgcgtcatcgcattattcatcgagaaattcttcaaacatttataccctgccattccaatcttagatgaacagaatttcaaaaatcacgtgaatcaaatgctttcgttgtcttcgatgaatcccacagttaacaactttggtatgagcatgccatcttcatctacactagagaaccaacccataacacaaatcaatcttccaaaactttccgattcttgtaacttaggtattctgataataatcttgagattgacatggctatccataccttctaattcctgcgaagtcgacctgggagaagaaagtggctcatttttagtgcccaacgaatctagcaatatgtctgcatctgcattgacctcgatggctaaagaagaatcacttctgctaaagcatgagacaccggtcgaggcactggagctatgtcaaaaatacttgattaaattcgatgaactttctagtatttccaataacaacgttaatttaaccacggtgcagtttgccattttttacaacttctatatgaaaagtgcctctaatgatttgactaccttgacaaataccaacaacactggcatggccaatcctggtcacgattccgagtctcaccagatcctattgtccaatattactcaaatggcctttagttgtgggttacacagagaccctgataattttcctcaattaaacgctaccattccagcaaccagccaggacgtgtctaacaacgggagcaaaaaggcaaaccctagcaccaatccaactttgaataacaacatgtctgctgccactaccaacagcagtagcagatctggcagtgctgattcaagaagtggttctaaccctgtgaacaagaaggaaaatcaggttagtatcgaaagatttaaacacacttggaggaaaatttggtattacattgttagcatggatgttaaccaatctctttccctggggagccctcgactactaagaaatctgagggatttcagcgatacaaagctaccaagtgcgtcaaggattgattatgttcgcgatatcaaagagttaatcattgtgaagaattttactctttttttccaaattgatttgtgtattattgctgtattaaatcacattttgaatgtttctttagcaagaagcgtgagaaaatttgaactggattcattgattaatttattgaaaaatctgacctatggtactgagaatgtcaatgatgtagtgagctccttgatcaacaaagggttattaccaacttcggaaggtggttctgtagattcaaataatgatgaaatttacggtctaccgaaactacccgatattctaaaccatggtcaacataaccaaaacttgtatgctgatggaagaaatacttctagtagtgatatagataagaaattggaccttcctcacgaatctacaacgagagctctattcttttccaagcatatgacaattagaatgttgctgtacttattgaactacattttgtttactcattatgaaccaatgggcagtgaagatcctggtactaatatcctagctaaggagtacgctcaagaggcattaaattttgccatggatggctacagaaactgcatgattttcttcaacaatatcagaaacaccaattcactattcgattacatgaatgttatcttgtcttacccttgtttggacattggacatcgttctttacaatttatcgtttgtttgatcctgagagctaaatgtggcccattgactggtatgcgtgaatcatcgatcattactaatggtacatcaagtggatttaatagttcggtagaagatgaggacgtcaaagttaaacaagaatcttctgatgaattgaaaaaagacgatttcatgaaagatgtaaatttggattcaggcgattcattagcagagattctaatgtcaagaatgctgctatttcaaaaactaacaaaacaactatcaaagaagtacaactacgctattcgtatgaacaaatccactggattctttgtctctttactagatacaccttcaaagaaatcagactcgaaatcgggtggtagttcattcatgttgggtaattggaaacatccaaaggtttcaaacatgagcggatttcttgctggtgacaaagaccaattacagaaatgccccgtgtaccaagatgcgctggggtttgttagtccaaccggtgctaatgaaggttctgctccgatgcaaggcatgtccttacagggctctactgctaggatgggagggacccagttgccaccaattagatcatacaaacctatcacgtacacaagtagtaatctacgtcgtatgaatgaaacgggtgaggcagaagctaagagaagaagatttaatgatggctatattgataataatagtaacaacgatatacctagaggaatcagcccaaaaccttcaaatgggctatcatcggtgcagccactattatcgtcattttccatgaaccagctaaacgggggtaccattccaacggttccatcgttaaccaacattacttcacaaatgggagctttaccatctttagataggatcaccactaatcaaataaatttgccagacccatctagagatgaagcatttgacaactccatcaagcaaatgacgcctatgacaagtgcattcatgaatgctaatactacaattccaagttcaactttaaacgggaatatgaacatgaatggagctggaactgcgaatacagatacaagtgccaacggcagtgctttatcgacactgacaagcccacaaggctcagacttagcatccaattctgctacacagtataaacctgacttagaagactttttgatgcaaaattctaactttaatgggctaatgataaatccttccagtctggtagaagttgttggtggatacaacgatcctaataaccttggaagaaatgacgcggttgattttctacccgttgataatgttgaaattgatggtgttggaataaaaatcaactatcatctactaactagtatttacgttactagtatattatcatatacggtgttagaagatgacgcaaatgatgagaaa

SEQ ID NO: 2 - protein, 1502 aa, Saccharomyces cerevisiae
MSNTPYNSSVPSIASMTQSSVSRSPNMHTATTPGANTSSNSPPLHMSSDSSKIKRKRNRIPLSCTICRKRKVKCDKLRPHCQQCTKTGVAHLCHYMEQTWAEEAEKELLKDNELKKLRERVKSLEKTLSKVHSSPSSNSLKSYNTPESSNLFMGSDEHTTLVNANTGSASSASHMHQQQQQQQQQEQQQDFSRSANANANSSSLSISNKYDNDELDLTKDFDLLHIKSNGTIHLGATHWLSIMKGDPYLKLLWGHIFAMREKLNEWYYQKNSYSKLKSSKCPINHAQAPPSAAAAATRKCPVDHSAFSSGMVAPKEETPLPRKCPVDHTMFSSGMIPPREDTSSQKRCPVDHTMYSAGMMPPKDETPSPFSTKAMIDHNKHTMNPPQSKCPVDHRNYMKDYPSDMANSSSNPASRCPIDHSSMKNTAALPASTHNTIPHHQPQSGSHARSHPAQSRKHDSYMTESEVLATLCEMLPPKRVIALFIEKFFKHLYPAIPILDEQNFKNHVNQMLSLSSMNPTVNNFGMSMPSSSTLENQPITQINLPKLSDSCNLGILIIILRLTWLSIPSNSCEVDLGEESGSFLVPNESSNMSASALTSMAKEESLLLKHETPVEALELCQKYLIKFDELSSISNNNVNLTTVQFAIFYNFYMKSASNDLTTLTNTNNTGMANPGHDSESHQILLSNITQMAFSCGLHRDPDNFPQLNATIPATSQDVSNNGSKKANPSTNPTLNNNMSAATTNSSSRSGSADSRSGSNPVNKKENQVSIERFKHTWRKIWYYIVSMDVNQSLSLGSPRLLRNLRDFSDTKLPSASRIDYVRDIKELIIVKNFTLFFQIDLCIIAVLNHILNVSLARSVRKFELDSLINLLKNLTYGTENVNDVVSSLINKGLLPTSEGGSVDSNNDEIYGLPKLPDILNHGQHNQNLYADGRNTSSSDIDKKLDLPHESTTRALFFSKHMTIRMLLYLLNYILFTHYEPMGSEDPGTNILAKEYAQEALNFAMDGYRNCMIFFNNIRNTNSLFDYMNVILSYPCLDIGHRSLQFIVCLILRAKCGPLTGMRESSIITNGTSSGFNSSVEDEDVKVKQESSDELKKDDFMKDVNLDSGDSLAEILMSRMLLFQKLTKQLSKKYNYAIRMNKSTGFFVSLLDTPSKKSDSKSGGSSFMLGNWKHPKVSNMSGFLAGDKDQLQKCPVYQDALGFVSPTGANEGSAPMQGMSLQGSTARMGGTQLPPIRSYKPITYTSSNLRRMNETGEAEAKRRRFNDGYIDNNSNNDIPRGISPKPSNGLSSVQPLLSSFSMNQLNGGTIPTVPSLTNITSQMGALPSLDRITTNQINLPDPSRDEAFDNSIKQMTPMTSAFMNANTTIPSSTLNGNMNMNGAGTANTDTSANGSALSTLTSPQGSDLASNSATQYKPDLEDFLMQNSNFNGLMINPSSLVEVVGGYNDPNNLGRNDAVDFLPVDNVEIDGVGIKINYHLLTSIYVTSILSYTVLEDDANDEK

SEQ ID NO: 3 - DNA, 3780 bp, Kluyveromyces lactis
atgagctctattacctcacctggaacaggcaccccgcagcagaagcggaagagaaacagagtacccctgagctgtacaatatgtcgaaagaggaaagttaagtgtgacaaaggacggcctcagtgccagcaatgtgtcaagactggtgttggtcatctatgccattatatggaacagacgtgggctgaagaagccgagaaagagctgtcgaaggattcggagttgaagcagcttagagaacgtgtgaagtctttggaagaaactctttcaaaagttcatgccactacgacgaatcctatgaccagtgctaaccagagtccagcgtcagatggtttgaatgtcggttgtcctcatgcaggtggcagtactcaacggctgttatccggatccaatggaaattcacctattctaagtacggaacaaacgccatccaatgagaataagtatgataacgatgagttggatttgacaagacagttcgatatgttacatttgaaaaataatggtactgtgcatcttggagctacccattggttggcaataatgaaaggtgatccttacttaaaacttctctggggtcatatcttcacattaagagagaagctcacggaatggtattctcagaaacggaaatctagtaccgtctccgctggtgcaggtacatgtcccgtcattcatggctcaatacaacaatccaaatgtccagttgcacatgcaactaggaacgttgcagagagaccgaagagctctgagtcacgttgccctgtagcacatgctcctaggcccgagaaaaactccacacaaaaatgccctgttgaccatagtgctttcatcggttctgctagctcgggtcaatgccccgtggcacataccgttgtcaaggaagaagttgacgcaactacttctggatgtccaatagaccacacaaagttttcctctatggaaggttctcctgatcctgcagctaagggaaagcttccggctttgccgtctttccaaaatttgacagcgaaatgtccaatgcttcgcgagggaactccaaccccaacgttgaacagccaggaatctgggcataattcgaaacgcactagtgtagtgccggagatgtcatcagagcaggccactgatgccataagcaaggccttgccaccaaaaaaaatcgtattccttttcatggataaattctttaatcacatttacccaatcgtacctatacttgatgagcagaccttcaaactacaggtaaatcaaattttgcaaacaaataataaccaaacaactgtcaaattgacgaagccgttagatgcttgtgttttggggatattattgattattttgagaataacatggctttccttgactcccaacgcatgcaatatcaagttaggaccagagtgcgaatcgttaaaattagaacctacatactccgctactatcacacaggctaaagaggaagccatgctattaaaatacgaaacacctattgaaacagtggagattgtaaggaaatttttgatcaagtttgatgaaatcagtagtttcgcaaactccaatgttaacatcaccacagttcaatttgccattttctacaaattgtatctcatgtcctctccggataagacggattatacacaacccaacacatttacctcaacgggtcaagataatgagacccaccaagttcttatgcccagtattgtgcaaatggctttcagctgtggattgcaccgtgatcctgataatttccctcaactaaacacagcagtcaatggttccaagttgacgaaagaagctttgtcgaataccgagagattgaaacatacatggaggaaaacctggttctttattgtctcacttgatgttcaacagtctctatcactaggtacacccagattattacgtaatctaaatgacttcagtgacactaaacttccctgtgcatcgaagatcgattatgtgaacaatatcaaggaactcatcctggtcaagaatttcacattgttcttccaaattgacttatgtatcatctctgttttgaatcatattttgaatgtttctcttgcaaggacagttagaaaatttgagcttgaccaactaatacaaagcttaggtaaactacgtgatggtgttactccgacgaatgatgttgtcaatgatcttgttaataaaggcctattatttaccacagaaggaactgtgcttttggaccaaaacccagagcattcctattcgttaccatccttaacatccgttctttcaacagtagataaaagctcttcagaagaaaaggaaaagaaactcagtctcgcccacgaatccaccacaagagctttgtttttctcaaaacatgtcacaattagcatgctacaatatttgttaaactacatcttattcacgcattacgaaccgttaggtaacgaagaccccggcacaagaattttagctaaagattatgcacaagaagccctcaactatgcagtggaaggcttcaaaaactgcatactcttctataacagcaccggtatgaacaacatgttcagttatatggatgtgcttttgtcgcccacctgcttggacgtcggacatcgtgctttacagtttatcgtttgcctaattttgcgggctaaatgtggccctttaacaggtatgggtgaatccccagctataggtaaccaaaataacactgttactagcagcagcgaagatgaaacagaccaaatgaagagagattcatccccatctccaggaaacgtccttacagatgtcagtctggatgcaggtgaaaacttagccgaagttctcctcgcaagaatgatcttatttcacaagttgacaaaacaaatctctgccaaatataactatgccgtaagaatgacgaaatccacaggtttctttatcactttacttaagaaaccttcctcgaaatccaaaactaactctaaaaacaaaaacctaccacgtttgcatcaacatccaaatattgcaaatatgacgagtttcttcaaaaacgttccatcattggtactttcagcaggaggggatcaaattagacgttgcccggtttatcaggacgcagttgggtttttgccttcgaaagtaacaagcggaaccttcaactcgatttttcactccactgctcctccttctttcaactctgccgttacacaacaattgcccccactgaatatacagtatcaaccaatcacttttagggacactttaagacgcacatcagatgtgagaggtactcctgaaactgcgaaaagaaggaaagtagacaccacatctaaaaacttctctgagcaaaaagttgaagtaaaggtggaaaatcctcaaatatctttaccaccttctccagcgcagatttctgcggtaactccctttgagcctttgcttccaactttggacaaagtgcctgcagttccacaaggaaaggttccatatagcccaacaccaagtttgtctggaacacagcctcctattgttgcaccttctaacttacagcaattaaatttcaactctccagtacccccatcagatttatctaacatcactgattcccctgactttgaggacttcctatccgaacacacatcacttaatggattaatgataaacccgtcatccatagtggaagctgttggatttgatggttattctgggaatggtgggcttcgcttacaagccgatttcttaccgatagataataatgatggcttgaacgaaatggcaccatcacagaattttcgatgtggaatgatgaatgagttcattgttact

SEQ ID NO: 4 - protein, 1260 aa, Kluyveromyces lactis
MSSITSPGTGTPQQKRKRNRVPLSCTICRKRKVKCDKGRPQCQQCVKTGVGHLCHYMEQTWAEEAEKELSKDSELKQLRERVKSLEETLSKVHATTTNPMTSANQSPASDGLNVGCPHAGGSTQRLLSGSNGNSPILSTEQTPSNENKYDNDELDLTRQFDMLHLKNNGTVHLGATHWLAIMKGDPYLKLLWGHIFTLREKLTEWYSQKRKSSTVSAGAGTCPVIHGSIQQSKCPVAHATRNVAERPKSSESRCPVAHAPRPEKNSTQKCPVDHSAFIGSASSGQCPVAHTVVKEEVDATTSGCPIDHTKFSSMEGSPDPAAKGKLPALPSFQNLTAKCPMLREGTPTPTLNSQESGHNSKRTSVVPEMSSEQATDAISKALPPKKIVFLFMDKFFNHIYPIVPILDEQTFKLQVNQILQTNNNQTTVKLTKPLDACVLGILLIILRITWLSLTPNACNIKLGPECESLKLEPTYSATITQAKEEAMLLKYETPIETVEIVRKFLIKFDEISSFANSNVNITTVQFAIFYKLYLMSSPDKTDYTQPNTFTSTGQDNETHQVLMPSIVQMAFSCGLHRDPDNFPQLNTAVNGSKLTKEALSNTERLKHTWRKTWFFIVSLDVQQSLSLGTPRLLRNLNDFSDTKLPCASKIDYVNNIKELILVKNFTLFFQIDLCIISVLNHILNVSLARTVRKFELDQLIQSLGKLRDGVTPTNDVVNDLVNKGLLFTTEGTVLLDQNPEHSYSLPSLTSVLSTVDKSSSEEKEKKLSLAHESTTRALFFSKHVTISMLQYLLNYILFTHYEPLGNEDPGTRILAKDYAQEALNYAVEGFKNCILFYNSTGMNNMFSYMDVLLSPTCLDVGHRALQFIVCLILRAKCGPLTGMGESPAIGNQNNTVTSSSEDETDQMKRDSSPSPGNVLTDVSLDAGENLAEVLLARMILFHKLTKQISAKYNYAVRMTKSTGFFITLLKKPSSKSKTNSKNKNLPRLHQHPNIANMTSFFKNVPSLVLSAGGDQIRRCPVYQDAVGFLPSKVTSGTFNSIFHSTAPPSFNSAVTQQLPPLNIQYQPITFRDTLRRTSDVRGTPETAKRRKVDTTSKNFSEQKVEVKVENPQISLPPSPAQISAVTPFEPLLPTLDKVPAVPQGKVPYSPTPSLSGTQPPIVAPSNLQQLNFNSPVPPSDLSNITDSPDFEDFLSEHTSLNGLMINPSSIVEAVGFDGYSGNGGLRLQADFLPIDNNDGLNEMAPSQNFRCGMMNEFIVT

SEQ ID NO: 5 - DNA, 4116 bp, Candida glabrata
atgaacaacacgccgatgcctcccatgaacagcgcgggcgttaatatgaacagcgcgatgtatgcgttgcctatgccgcaggataacgccgatgtggcgaaaagtagcaaagacgctggcgcaaacatgaacaagaacaccagcaatatcaagaacaaagagaaggagaaagagaaagtgaagcggaagagaaacagggtgccgttgagctgtaccatttgtcggaggcggaaagtcaagtgtgataagtcccgcccaaactgtacacagtgtgtgaaaaccggtgtggcacacctgtgccactacatggaacaggcttgggctgaggaggcagagaaggaaatatcgaaggagatggagttaaaacagctgcggtcgaaggtgaagcaactggaggagacactctcccgatataactctctgaccgatgtgaccagtggactgcacatgaacaccggctcgccatacccacatagcagggactcgagctcaaacccgacaacagcaactactacaaataacaatagcaattacaacacagggacattcaatagccccgccgttcatgacccaaagataaagactgaacataacgatttcgcaaataacgactctatgactgacgcttacatgaatagtatattcaaaaaatttgaatccgacgaacttgacctaacgagagaatttgacatgctccacttaaagaaagactacggtttgatacatctgggaccaactcattggttggcgatcatgaaaggtgatccgtacttgaagctgctgtggaaacacatcttcactatgagggagaaattagttgaatggactaaaatgaaacagatggggaaagtctctaaatgtcccatcgatcattctaaattgaaacaaggacaaccacagattaacaatggtcaatatactaatgtcaatggaaatgcgataaatccgggcaaatgccctgtgaaacatgactcaacacttagccctggcatatctaaatgtcccgttaaacacgaaaatggaacagatatgaatacaattaacaatttgccaatgggtccaaccactgctgttcatcctggtgtaggcgccaatccacctacaagtggttgtccggttcaacatggtgggaacagttttatcccgggatttataggcgggcatcagcaagctaacagcaatgtcccacaaatggatgcgaaaggaaattcggcaggtattggcaaatgccctgtgacacattcagtgaaacaagaaaatgaaaagtccgcctcgccaacattaccagaggtttcgcaaccatctttcaccaaaaaggaagtcatggagcaattacaaagttctttaccaccgcgaggaattgtaatattgttcgttaataaattttttgagaccctttatcaattggctcctattatagatgaaactaatttcaaaaaccaattgaacatcgtattcccagaactgaatattttcgaggggcataaggctaaggataaaacctccagatgtccattcgatcattcaaaactttcgactattaatatcacgaaaagttcagattattgtttattaggtatgctgttgattattatgcgactggtctggttacagttacctgctaatgttaatattttatctttttcagataacagcaaaataaccatgtctacagatgacaagctgttgagtggttttgaaatcaaaacagaactaatcgaatctctgaaaactcgtcttattgaatttgatgaaatttctagcgtatccaatgcaaatgtcacaattagcacaattcagtttgccattttttacagaataatactgctctgcaatactaataacgcaccttctggtggcaccctcagtgctttaaaaacagttaataatgataatgaaactcatcaaggtttactttcaagtattgttcaaatggctttcagttgtggtcttcacagagaccctgataattttcctcaactagtcactgtcttccccaatcagtctgcagatagctcagactcagctgataataaagaccaatcaagaaatagcaccaaaggaaactcaaaacaccataaagaaaatacaattgagagatacaaacatacttggagaaaattatggtattatatcatttcattggatattcagcaatcattttctttgggtactccaagacttctaagaaatttgaaagactttagtgatacgaaactaccatcttcatctaaaattgactacaagaatgatatcaaggaactggttattgttaaaaattttaccctgatttttaagctagatttgtgtatcatggcagttctgaatcatattctgaacttgtctattgctcggagtttgaagaagaaagatttagattcgctaataaagctactatcagacctaatatttggagaaagaaatgttaatgaagttgtaagtgaattaattgaaagaaatttgctctcatcttctgagttggttgcaactaatatgcaggaaaatctgctctttgagcaatctactcatcctgttgcagacgatgttaaggatgcggttctgtatgggctaccaactctagaaagcctatatgcaaaaaatgaaataccatttaaggatatcatgctctccaagaattctggatatgggggagaaagcaaatctgaaaatttaagtaggtccgataaggttaaaaatactttgacctactcgttattatactcaaggcatttgactttgaggcttctagtttacattatgaactatatcttgtttactaggtatgaacctctgggcgactcagatccggatactatcattatcaccaaatattatgctcaagaagcactggacttttctgtggattgtttcaagaactctatgattttttttgaaaacatcaacaatccaattttcaagtcagctagtgttcttctacttcctcagtgcttagacgtttgtcatcgatcacttcaatattttatctgtttgattcttagagtgaagtgtgggaatattacaggtaacggtggaggacaatgtccattttttgctgtcaagaatgaatcaggaaccgaatcagaaaatgaaaaggaagcagatttgaacaatccaggatttttaaatggtaaggatattatgtccatgagcacttcgaagattgatctggatgatacagacagcttactccaaacattgatatctaatatatctagtttctactcactgacacaaagattagccaaaagttatacgctggcaatccggataatgaaatctaccggctttttcatgacccttttgaacgatcagagctctaaaaaccaaatgaattcctttttacctccaaagcacccaaaaattcctagtattgctagccttctgagaaatgacggtgcagcatttttgaatgcggacgtgagtcagttgagaagatgtcctgtttatcaagatactattgggttcgatgtgactagaaactcttcctttccaggtcctttacgaacttctattgatcgtattgggactcaattaccgccacttaaatcgtataagccaattacctacacaagtagtgatgttcgtggttgttcttctaggggagctagtaggggtagttcggcaatatcatctccaggagttagcaacctcgacggtcctcctattaaaagacaaagaaccatggagaatataacatcgataccaagacctactgagaagcacatgggaaggttgaatggtttcgatatgataaataattcaaatggtaacatattagatgtaaacaaccttcccgttcccgcactaaatcccctctcaccgaatggtatgcttttccaagatctaggtgccactccaaatcacactgctaatggaactgcagtaggaactccgaatgatcttgaaaacttcttgatggccaacacaaatttcaatggtatcaatccgtcgaatattgttgaagcattcggtattaacaagacagatcctaatttgggtcttacaaatatggattttcttcctattgacaacttgggttttgattatgaacctgatttaaacaacatatttaatggagaaacaggaactctaaaatttgatacaaatgaaactatc

SEQ ID NO: 6 - protein, 1372 aa, Candida glabrata
MNNTPMPPMNSAGVNMNSAMYALPMPQDNADVAKSSKDAGANMNKNTSNIKNKEKEKEKVKRKRNRVPLSCTICRRRKVKCDKSRPNCTQCVKTGVAHLCHYMEQAWAEEAEKEISKEMELKQLRSKVKQLEETLSRYNSLTDVTSGLHMNTGSPYPHSRDSSSNPTTATTTNNNSNYNTGTFNSPAVHDPKIKTEHNDFANNDSMTDAYMNSIFKKFESDELDLTREFDMLHLKKDYGLIHLGPTHWLAIMKGDPYLKLLWKHIFTMREKLVEWTKMKQMGKVSKCPIDHSKLKQGQPQINNGQYTNVNGNAINPGKCPVKHDSTLSPGISKCPVKHENGTDMNTINNLPMGPTTAVHPGVGANPPTSGCPVQHGGNSFIPGFIGGHQQANSNVPQMDAKGNSAGIGKCPVTHSVKQENEKSASPTLPEVSQPSFTKKEVMEQLQSSLPPRGIVILFVNKFFETLYQLAPIIDETNFKNQLNIVFPELNIFEGHKAKDKTSRCPFDHSKLSTINITKSSDYCLLGMLLIIMRLVWLQLPANVNILSFSDNSKITMSTDDKLLSGFEIKTELIESLKTRLIEFDEISSVSNANVTISTIQFAIFYRIILLCNTNNAPSGGTLSALKTVNNDNETHQGLLSSIVQMAFSCGLHRDPDNFPQLVTVFPNQSADSSDSADNKDQSRNSTKGNSKHHKENTIERYKHTWRKLWYYIISLDIQQSFSLGTPRLLRNLKDFSDTKLPSSSKIDYKNDIKELVIVKNFTLIFKLDLCIMAVLNHILNLSIARSLKKKDLDSLIKLLSDLIFGERNVNEVVSELIERNLLSSSELVATNMQENLLFEQSTHPVADDVKDAVLYGLPTLESLYAKNEIPFKDIMLSKNSGYGGESKSENLSRSDKVKNTLTYSLLYSRHLTLRLLVYIMNYILFTRYEPLGDSDPDTIIITKYYAQEALDFSVDCFKNSMIFFENINNPIFKSASVLLLPQCLDVCHRSLQYFICLILRVKCGNITGNGGGQCPFFAVKNESGTESENEKEADLNNPGFLNGKDIMSMSTSKIDLDDTDSLLQTLISNISSFYSLTQRLAKSYTLAIRIMKSTGFFMTLLNDQSSKNQMNSFLPPKHPKIPSIASLLRNDGAAFLNADVSQLRRCPVYQDTIGFDVTRNSSFPGPLRTSIDRIGTQLPPLKSYKPITYTSSDVRGCSSRGASRGSSAISSPGVSNLDGPPIKRQRTMENITSIPRPTEKHMGRLNGFDMINNSNGNILDVNNLPVPALNPLSPNGMLFQDLGATPNHTANGTAVGTPNDLENFLMANTNFNGINPSNIVEAFGINKTDPNLGLTNMDFLPIDNLGFDYEPDLNNIFNGETGTLKFDTNETI

SEQ ID NO: 7 - DNA, 4287 bp, Pichia pastoris
atgggttcacaagacgagaacctttgtccctccgagcggatcaaactaaagcgaaagagaaacagagttccagtatcatgtacgatttgtcgtcgtcgaaaagtgaagtgtgataagaaaaaaccgatttgcactaactgtaagaaaaatggtgttcctcatttatgctattatctagagccctcgtgggccaaaccactggtaaacagtgagcttctttcaatgggtggcaatccggagcagttgacgagtgctcaacccgtccctgcgtccattattgtcaatactcccagtaataccttagatcataaccaaagtgactcaatccaaaaagacgaggaggtccgacaacttcgtcaaagagtccaggatctggagaagctgctgatggaaaaaggcgacactggggcccagatacatcgaaatgctgatggatccctccccgatgacagggaagtggtgaatctaatagcaaactcggatatcttatacacgaccagacacgaacaaaagttcatgttccccttgatctacaaaatcaacatattctcctggctcttcattaccaagactgatgcctatctgaacgatttgtggcagaagattttcaacttgagacgacattatgagtactattacaataaccatacagtggccgatgcgtcactggcatctttgggatccttgtctactccactcaaaaattccttatcatccggatctaattttcaggaacccaatacccttgccgtggactttacctctggcctttccaactcctctaaacgtccctttgagcacatggatcaatcgaaccaatcagacttcaaggaaactgaaattaaaaaggaagttctatcatcagataggacgataagtcaaaccacaactccctcatccaacgattcctcatcgggtgctgctccaacttccatgtgccccgtcaccggagagatgggacaatgccctgtctcgggtaacatggagaaagacgttgttaatatgaaggaggtgaacctcttgagtggtaataccggaaaatgtcctgtaattccaacttctgagtccgttttccccaacttgtcttcagaggaagacaagaacgaacccagagtatgccccttgatgattggagatgcaagatctctctttagagagaaattgtccaagttgaatgacactaacttggcaaaaagagcactggttgcgtcggcctataactctccaatgttggattcgacaaacacagcaatgaaccataacccaggatccgtgcagatgaaaaaatctagcagcgatgaaagcaagattagtccttctaatacgccttccccaagtgtgtatcaatcgcctctaactcttaccccaatgcagttagatacatctcaagatgacgacaaatggaatggcggaaatactgggtgccctgttcttggatgtgatatgaacagcaagaagcccaaatctagcaagaaaaaaataaagaccttcaccattacatctgtcaagcatctaaattactcgaataccaagcaggcgatcaacattatagagaaaaacatacctcctagaaaagtatgttggctacttgtggatcgattttttgacctcctttaccttcaatttccctgcattgacgaggtttcattccgcaaaaaagtggctagcattattggtcctaaagatggttctacaaataaaatcagactcagttcactgggaagcaactacaatgaggacttcatgactgtctgtcttttgatattattgatacgcttaagttggttatcattgcctattaatttagcccgaaagtacgatagacctcttactaatgaggagaagatcatgtcaaaaccggagaatctagtccccatggttctagttgacctcatcaaggaaattttcaccaacactaagatgtttgggaagccatcaattgtgattctacaagttggaatctttttgaagtgttacaatattttttctccggaagacggatttgatttggacgattcatacaatacatccagtgcaagcgatgccactggggatatcactagcgaatcgttaaacctcaacagcattaatttcctaagttccctagtcactttagccaacacaattggaatcaacagagacccattattctacagaaatttccaatcgacttgttccaatgactcacaagcaaacataaacctattccgtaaaaggcatttatggaggaagctttggttcactctgattagtttgaatgtggtgactaatatcagtcttggagactactcaaaaatgttggccatcaacctggatatggatcctgtcatgggcactcaaaataaatcatgggattgcaaacttcctggcgaagttgaatctgaattgttgtctgaagcattctcagacccagcgcttctggaaagagaactaaaagttgtctccaactacaagctggaatatgaggttaattataccatctttcagggtatggatctgctgatcaaccatagcaaagttccttctaaggagaatgtcgatctagttctaggcaaactgaatgacattgttaagagagatgaaagatatacaggcatacctactccgtgggacatgaaaacagagccgttcttggtattctacgaagactcttcaaactcttccaagcttgacattgtggttagaatattcaagttcaggcttttcttgactgctaaaatcctcctatttgtgatcaactatataatgttcattaactacgaaaaggaactacaaagctgtcctgaagaaaaaatagcaacgtatcaaggttacttcaaccgctatttcgaagatactctattgcttgcaattgaggattacaagttatttggagacttttttgataactctgcgaagtatttccctaatcatggcggagagttgatgttatacccatttctgatgattctcaaccaccgatcgaatcagtttttgatttcgataattctgagattgcaacaggattcagaacctactatccaacttctgaatcacaatgggattgctagggatgaccttttgatgagactattccaatacttgaagaactttctggaaaagttggatcaactcaccaagaactactattacgcctggagattaaagaaactgatcagattcttctataatgtcttggtgaactccaacagactgtttagtatcaactttgacaatttgaattcaggtattgaaagaaaatccattcatgaccgcaagaactcaagtcaatcgccttcggcaaccaatctgttcaagaggctgaaaggcagtaatagcaatagttccaataacgttgctgaacctgtgcaatgtcccgtgttcagaaatattgatacacagtttgtccctacattggtgtcccagccttccagccaacctgcaagtgtaaatggcagtttcagtcaccaatctaataacaagggctatagacaaagtatagaaacagagggtcctcaatcgtctcaagctaaacagattatggaaagctttccacttttcagcatggaaaatagcgagaatattcaaaagaatatcgagtttcttaatgacaatttctttatggacttgaatgactttgatgatgcagttgatgatttgactccggtcagtacaagctttcctatggcggagaattcattatttcaaaacagtaatgaaattgatttcacttatgcagatatctcatcgttttctcgtgatagattcccagcccagcaggaacagcaacagcaacatcaacaacaacatcaacgtcaacaacagcaacagcaacagcaacagcaacatcagcaaccacaacaacatcaacaacatcagccacatcagcaacagcagcagcaacatcatcaacatcagaagacgcagcagcaacagccgattgctccagtttcccagatgcttggctcgtcatctaatttacctaatgactccgtacaacgttcttctcccatttttcctggatcgccaaatagaatgagcgagaatgaacagctgactcgtccgttcacgcagaatttcaccggacaggaagaactgcaggacggtcatcaaaatgaacagctccaaccgagatcattaacgcccagatctcaagagcaacatgagcagcagcagttgcaacagaggcagcagcaaagctcccaacttggagtgaacgttgtaaggatgcgaacgggaaatacacccgagcaaccgcctcaggagcaatcacaacagcctgctgcccctatttggaactacccatat

SEQ ID NO: 8 - protein, 1429 aa, Pichia pastoris
MGSQDENLCPSERIKLKRKRNRVPVSCTICRRRKVKCDKKKPICTNCKKNGVPHLCYYLEPSWAKPLVNSELLSMGGNPEQLTSAQPVPASIIVNTPSNTLDHNQSDSIQKDEEVRQLRQRVQDLEKLLMEKGDTGAQIHRNADGSLPDDREVVNLIANSDILYTTRHEQKFMFPLIYKINIFSWLFITKTDAYLNDLWQKIFNLRRHYEYYYNNHTVADASLASLGSLSTPLKNSLSSGSNFQEPNTLAVDFTSGLSNSSKRPFEHMDQSNQSDFKETEIKKEVLSSDRTISQTTTPSSNDSSSGAAPTSMCPVTGEMGQCPVSGNMEKDVVNMKEVNLLSGNTGKCPVIPTSESVFPNLSSEEDKNEPRVCPLMIGDARSLFREKLSKLNDTNLAKRALVASAYNSPMLDSTNTAMNHNPGSVQMKKSSSDESKISPSNTPSPSVYQSPLTLTPMQLDTSQDDDKWNGGNTGCPVLGCDMNSKKPKSSKKKIKTFTITSVKHLNYSNTKQAINIIEKNIPPRKVCWLLVDRFFDLLYLQFPCIDEVSFRKKVASIIGPKDGSTNKIRLSSLGSNYNEDFMTVCLLILLIRLSWLSLPINLARKYDRPLTNEEKIMSKPENLVPMVLVDLIKEIFTNTKMFGKPSIVILQVGIFLKCYNIFSPEDGFDLDDSYNTSSASDATGDITSESLNLNSINFLSSLVTLANTIGINRDPLFYRNFQSTCSNDSQANINLFRKRHLWRKLWFTLISLNVVTNISLGDYSKMLAINLDMDPVMGTQNKSWDCKLPGEVESELLSEAFSDPALLERELKVVSNYKLEYEVNYTIFQGMDLLINHSKVPSKENVDLVLGKLNDIVKRDERYTGIPTPWDMKTEPFLVFYEDSSNSSKLDIVVRIFKFRLFLTAKILLFVINYIMFINYEKELQSCPEEKIATYQGYFNRYFEDTLLLAIEDYKLFGDFFDNSAKYFPNHGGELMLYPFLMILNHRSNQFLISIILRLQQDSEPTIQLLNHNGIARDDLLMRLFQYLKNFLEKLDQLTKNYYYAWRLKKLIRFFYNVLVNSNRLFSINFDNLNSGIERKSIHDRKNSSQSPSATNLFKRLKGSNSNSSNNVAEPVQCPVFRNIDTQFVPTLVSQPSSQPASVNGSFSHQSNNKGYRQSIETEGPQSSQAKQIMESFPLFSMENSENIQKNIEFLNDNFFMDLNDFDDAVDDLTPVSTSFPMAENSLFQNSNEIDFTYADISSFSRDRFPAQQEQQQQHQQQHQRQQQQQQQQQQHQQPQQHQQHQPHQQQQQQHHQHQKTQQQQPIAPVSQMLGSSSNLPNDSVQRSSPIFPGSPNRMSENEQLTRPFTQNFTGQEELQDGHQNEQLQPRSLTPRSQEQHEQQQLQQRQQQSSQLGVNVVRMRTGNTPEQPPQEQSQQPAAPIWNYPY

SEQ ID NO: 9 - DNA, 1515 bp, Saccharomyces cerevisiae
atgcaaagcccatatccaatgacacaagtgtctaacgttgatgatgggtcactattgaaggagagtaaaagcaagtccaaagtagctgcgaagtcagaggcgccaagaccacatgcttgtcctatctgtcatagagcttttcacagactggaacatcagacgagacacatgagaattcatacaggtgagaagcctcacgcgtgtgacttccccggatgtgtgaaaaggttcagtagaagcgatgaactgacgagacacagaagaattcatacaaactcccaccctcgaggtaaaagaggcagaaagaagaaggttgtgggctctccaataaatagtgctagttctagtgctaccagtataccagatttaaatacggcaaatttttcaccgccattaccacagcaacacctatcgcctttaattcctattgctattgctccgaaagaaaattcaagtcgatcttctacaagaaaaggtagaaaaaccaaattcgaaatcggcgaaagtggtgggaatgacccatatatggtttcttctcccaaaacgatggctaagattcccgtctcggtgaagcctccaccttctttagcactgaataatatgaactaccaaacttcatccgcttccactgctttgtcttcgttgagcaatagccatagtggcagtagactgaaactgaacgcgttatcgtccctacaaatgatgacgcccattgctagcagtgcgccaaggactgttttcatagacggtcctgaacagaaacaactacaacaacaacaaaattctctttcaccacgttattccaacactgttatattaccaaggccgcgatctttaacggattttcaaggattgaacaatgcaaatccaaacaacaatggaagtctcagagcacaaactcagagttccgtacagttgaagagaccaagttcagttttaagtttgaacgacttgttggttggccaaagaaataccaacgaatctgactctgattttactactggtggtgaggatgaagaagacggactaaaggacccgtctaactctagtatcgataaccttgagcaagactatttgcaagagcaatcaagaaagaaatctaagacttccacgcccacgacaatgctaagtagatccactagtggtacgaatttgcacactttggggtatgtaatgaaccaaaatcacttgcatttctcctcatcatctcctgatttccaaaaggagttgaacaacagattactgaacgttcaacaacagcagcaagagcaacataccctactgcaatcacaaaatacgtcaaaccaaagtcaaaatcaaaatcaaaatcaaatgatggcttccagtagttcgttaagtacaaccccgttattattgtcaccaagggtgaatatgattaatactgctatatccacccaacaaacccccatttctcagtcggattcacaagttcaagaactggaaacattaccacccataagaagtttaccgttgcccttcccacacatggactga

SEQ ID NO: 10 - protein, 504 aa, Saccharomyces cerevisiae
MQSPYPMTQVSNVDDGSLLKESKSKSKVAAKSEAPRPHACPICHRAFHRLEHQTRHMRIHTGEKPHACDFPGCVKRFSRSDELTRHRRIHTNSHPRGKRGRKKKVVGSPINSASSSATSIPDLNTANFSPPLPQQHLSPLIPIAIAPKENSSRSSTRKGRKTKFEIGESGGNDPYMVSSPKTMAKIPVSVKPPPSLALNNMNYQTSSASTALSSLSNSHSGSRLKLNALSSLQMMTPIASSAPRTVFIDGPEQKQLQQQQNSLSPRYSNTVILPRPRSLTDFQGLNNANPNNNGSLRAQTQSSVQLKRPSSVLSLNDLLVGQRNTNESDSDFTTGGEDEEDGLKDPSNSSIDNLEQDYLQEQSRKKSKTSTPTTMLSRSTSGTNLHTLGYVMNQNHLHFSSSSPDFQKELNNRLLNVQQQQQEQHTLLQSQNTSNQSQNQNQNQMMASSSSLSTTPLLLSPRVNMINTAISTQQTPISQSDSQVQELETLPPIRSLPLPFPHMD

SEQ ID NO: 11 - DNA, 1422 bp, Kluyveromyces lactis
atgacagaggcgattatagagaaaaaaaatcataagaagtctatcaatgatcatgacaaggatggaccaaggccttacgtctgtcccatatgtcaaaggggattccatcgactggaacatcagactaggcacatcagaacacacactggggaaagaccgcatgcatgtgatttcccgggatgttcaaaacgctttagtagaagcgatgaactaacaagacatagaaggatacatgacagtgataaaccaaaggggaaaagaggaaggaaaaagaagagtgagacgatagctcgtgaaaaggaattagaattgcagcggcaaaaacaacgaaacgcaaacgactctgcggctgttgattctgctggtggaacgagcgctaatgtcatagaaccaaaccacaaacttctgaaatccactaattcgattaaacaagatggttcaacatttactgaacctctgaaatcgttgaggtcgaagccaatgtttgatctcggtagcgatgaatcggatgaatgcggtatatatagtgtcccacctattagatctcagaataatagtggtaacatagaccttctgctgaatgctgcaaaatttgagtctgacaaagcctcatcctctttcaaatttattgataaactaccgttgacttcatcttcatcctctccgtcactttcgtttacatctcattcaatcaacaacagcagtagcggactattgttaccaagaccagcttcacgtgctaagctttctgctttatcatcattacaaagaatgacacccttgtctcaaaattcagagtcatataatcattcgcaacagaatctagtacatcttcaccatcccgcacccaaccgaccattgaccgagtttgttgataacgagtatataagtaacggtctgcctagaaccagatcgtggacaaatctgtcggaacagcaatcaccatcgggcttcagctcctctgcacttaactccagattctcgtcatccaatagtctcaaccaactgatagatcaacattcaagaaattcaagtactgtaagcatatctactctactgaagcaagaaaccgtaatctcacaagatgaggatatgagtacagaagatgcatatggccggccacttaagaaatcaaaagccataatgcccatcatgagacctagttctacaatgccaccaagttccggctcagctacagaaggagaattttatgatgaacttcattcaaggcttagatcgatggatcaactgccggtaaggaacagtaaggacgaaaaagattactatttccaaagtcatttttcaagtttactgtgcactccaacgcacagtcctccaccggaaggattgttacccagtttgaatcagaataagccagtgcagttgccatcacttcgaagcttagaccttttaccaccaaaa

SEQ ID NO: 12 - protein, 474 aa, Kluyveromyces lactis
MTEAIIEKKNHKKSINDHDKDGPRPYVCPICQRGFHRLEHQTRHIRTHTGERPHACDFPGCSKRFSRSDELTRHRRIHDSDKPKGKRGRKKKSETIAREKELELQRQKQRNANDSAAVDSAGGTSANVIEPNHKLLKSTNSIKQDGSTFTEPLKSLRSKPMFDLGSDESDECGIYSVPPIRSQNNSGNIDLLLNAAKFESDKASSSFKFIDKLPLTSSSSSPSLSFTSHSINNSSSGLLLPRPASRAKLSALSSLQRMTPLSQNSESYNHSQQNLVHLHHPAPNRPLTEFVDNEYISNGLPRTRSWTNLSEQQSPSGFSSSALNSRFSSSNSLNQLIDQHSRNSSTVSISTLLKQETVISQDEDMSTEDAYGRPLKKSKAIMPIMRPSSTMPPSSGSATEGEFYDELHSRLRSMDQLPVRNSKDEKDYYFQSHFSSLLCTPTHSPPPEGLLPSLNQNKPVQLPSLRSLDLLPPK

SEQ ID NO: 13 - DNA, 1362 bp, Pichia pastoris
  misc_feature (645)..(645): n is a, c, g, or t
atgactactgctcccccaacgaagcccaatgataggccctaccagtgccccatgtgcgacaaggccttccaccggttggaacatcaaacaagacacattagaacacacacaggggaaaaacctcacccttgcacgttccctggatgcccaaagaagttttccaggtctgatgaattgaccagacacttgaggatacacacaaacccaactgtgagaaagggcagaaagaagaagcggaaggacgaagaacaagctgtggagttgccacctcagaataacgaggtacatctcgttcccatggggaacgatcaaatgggacaaccaatatacacgcaggcggttcctgtttattgggttccatctggtgctgcaaacggcgaacaaggccagtatttgatgcctccgcttttttccttacaaccaagacaggtgatggcagggacttctcaaaccagtttgaatggtgtagatgctcaacaacagcagcagcagcagcagcagcagcaacaacaacaacaacaacaacaacaacaaccacagcaacaaccacagcaacaaccgccactgcaaccacaaccacttcaaccacaaccacaggcccagcaacaatttggatttgctcaagatcaaagaaacctggcaccngctaatcagcaacagcacagattctccccaccattttctgcatcttcaaggacccattcagccaattcattgttttctctcaactcaaatggatccacgccttcagggtcatatcaacagttgaactctttatctcttttacacagaatcactccaatcaggactccaagcagtaatagcctgttgacaaaatctaataaccagtcgatgacatcaatagtcacgttgagcgaccaacaacaggattttgtttccagaaaaaagtcaagacccaactcaccaacagttccaaactctccaacaatttcaaacttggtctcgcccgctgatacgcctttaactactccgttgcaatcgcctacactgaagcccgcaatgcccagcaacgtacaacttccaccaataagatcactgttaaatttggaagaacttccctcggaaccattgcagcaaccagccaatgtctctactgacaataaagtgaagacaatgttgaacaaatcttcgtccaacgtcactttgagtaaatcgttttcttcacaagacattcgtctggggaccaagagaaagtctgataccaacctctctgcattagattctaccaatgctattcgcaagcctgccctatcaccgttggctcctctgtcagtctcatcagatcgatttaccaagagaaagaacaacttcacgataggcaatatcatgaactcggactct

SEQ ID NO: 14 - protein, 454 aa, Pichia pastoris
MTTAPPTKPNDRPYQCPMCDKAFHRLEHQTRHIRTHTGEKPHPCTFPGCPKKFSRSDELTRHLRIHTNPTVRKGRKKKRKDEEQAVELPPQNNEVHLVPMGNDQMGQPIYTQAVPVYWVPSGAANGEQGQYLMPPLFSLQPRQVMAGTSQTSLNGVDAQQQQQQQQQQQQQQQQQQQQPQQQPQQQPPLQPQPLQPQPQAQQQFGFAQDQRNLAPANQQQHRFSPPFSASSRTHSANSLFSLNSNGSTPSGSYQQLNSLSLLHRITPIRTPSSNSLLTKSNNQSMTSIVTLSDQQQDFVSRKKSRPNSPTVPNSPTISNLVSPADTPLTTPLQSPTLKPAMPSNVQLPPIRSLLNLEELPSEPLQQPANVSTDNKVKTMLNKSSSNVTLSKSFSSQDIRLGTKRKSDTNLSALDSTNAIRKPALSPLAPLSVSSDRFTKRKNNFTIGNIMNSDS

SEQ ID NO: 15 - DNA, 1272 bp, Candida glabrata
atgtctgcatcagcgagtccggaacctcatacacctgaaaataatccctcgagcgttacgaatggttcatcgactccgaactcaggtaagtccaaggctggtaagggagatgacgcaccaaggccgcatgtgtgccctatctgtggaagagcattccataggctggaacaccaaactagacatatgagaacccatacgggtgagaagccacatgcgtgtgacttcccgggatgtgtcaagagatttagtagaagtgacgaactcacaagacatagaagaatacatacgaaccctctgcctaagggtaagagaggtaggaagaagaagcctgaaaccattttggctgaacaaagagcacgtgaagaggcagagaggaacaagaataaccccaactataaaccacccagtaagagcagtctgaggaggaagacgaaacgtaacaccacattcgagcttggtgaatctacgccaagttcaagcctcacgccaccacaacaaccaaacccccaagtccaattacccagctcacctatggttggtgatgaaacaacaaacgccccacattccgatggcatgacacctatagaacctcaaagattcttatcatcgccaccgaaccacgtcaggcctgtctttggcagtgccaacaacagtaacagcagcagcagaatacggcttaacgcgttgtcttcattacagatgatgacgcctctatctggcagaaacagtagctccactatgaatctatcacagcaagcgtcaaccacgttcttggataatcccgatggctctaagaatcaaaacatcatcctaccaagaccaaaatctttgacagatttcgcatccatgcatgcaaatggcagttctaccaacttaactacattaatgcagcaacccaatatgggcaacttgatgaaacgtccgaactcggtattgagtctgaatgagttggtgacacaatcgggtgcgggcacacatggttatgacacagggaacaattcatctctagaggaagacgacctcaaggaccctgaactagagaacgaccaattacgaaagaagtcgaagacagctacacctacaactggcttgagcagatccgcaagtggcctgaacctctctttgaagacgaagtcactaacaaacatgcaagacatgaacaaagtaaacgagaaactgctacaataccagaaaaacgtggtttccccacaaatagctccacaggacggcctcccaccattgagaagtttgcacttgcaatttccaactggt

SEQ ID NO: 16 - protein, 424 aa, Candida glabrata
MSASASPEPHTPENNPSSVTNGSSTPNSGKSKAGKGDDAPRPHVCPICGRAFHRLEHQTRHMRTHTGEKPHACDFPGCVKRFSRSDELTRHRRIHTNPLPKGKRGRKKKPETILAEQRAREEAERNKNNPNYKPPSKSSLRRKTKRNTTFELGESTPSSSLTPPQQPNPQVQLPSSPMVGDETTNAPHSDGMTPIEPQRFLSSPPNHVRPVFGSANNSNSSSRIRLNALSSLQMMTPLSGRNSSSTMNLSQQASTTFLDNPDGSKNQNIILPRPKSLTDFASMHANGSSTNLTTLMQQPNMGNLMKRPNSVLSLNELVTQSGAGTHGYDTGNNSSLEEDDLKDPELENDQLRKKSKTATPTTGLSRSASGLNLSLKTKSLTNMQDMNKVNEKLLQYQKNVVSPQIAPQDGLPPLRSLHLQFPTG

SEQ ID NO: 17 - DNA, 846 bp, Saccharomyces cerevisiae
atgatacaccaaccaataccgcaagtcctaccagcaaatatggccataaatgttcaggcagtaaatggaggtaacattatacacgctcccaatgcggtgcacccaatggtgataccaatcatggcccaaccagcccccattcatgcctccgctgcatctttccagcctgcaacttctcctatgccaatttctacatacactccagttccatcgcaatcattcacctctttccagagctctattggctccatacagtcaaatagtgatgtttcatctatcttctcgaacatgaatgttcgcgtaaacactccacgctctgtgccaaactctccgaatgatggatatttacaccagcaacatatcccacagcagtatcagcatcaaactgccagcccttctgttgccaagcagcagaaaacttttgcacattctcttgcatctgcattatctaccttacaaaaaagaacgcctgtaagtgccccttccaccactatagaatcaccatcctcaccaagtgattccagtcatacctctgcatccagcagcgctatctctttgcctttcagcaatgctccttctcagctcgccgtggccaaagaacttgagtccgtctatttagattccaatagatacaccaccaagactaggagggaaagagcaaaattcgaaattcctgaagaacaagaagaagataccaataacagcagcagtggtagtaatgaggaggagcacgagtcgctagatcatgaatctagcaaaagccgaaagaaattgtcaggcgtaaaattgccgcctgtacgtaacctactgaaacaaattgatgttttcaacggtcccaaaagagtt

SEQ ID NO: 18 - protein, 282 aa, Saccharomyces cerevisiae
MIHQPIPQVLPANMAINVQAVNGGNIIHAPNAVHPMVIPIMAQPAPIHASAASFQPATSPMPISTYTPVPSQSFTSFQSSIGSIQSNSDVSSIFSNMNVRVNTPRSVPNSPNDGYLHQQHIPQQYQHQTASPSVAKQQKTFAHSLASALSTLQKRTPVSAPSTTIESPSSPSDSSHTSASSSAISLPFSNAPSQLAVAKELESVYLDSNRYTTKTRRERAKFEIPEEQEEDTNNSSSGSNEEEHESLDHESSKSRKKLSGVKLPPVRNLLKQIDVFNGPKRV

SEQ ID NO: 19 - DNA, 1149 bp, Saccharomyces paradoxus
atgcctaaaaagcaaaccagtttcccagtagataacgaaaacagaccttttaggtgtgatacctgtcaccgtggtttccatcggttagaacataaaaagagacacttgagaacgcacactggagaaaagcctcatcattgcgcatttcctggctgtgggaaaagcttcagtagaagcgacgaactgaaaaggcacatgagaacgcatacaggacaatctcaaaggagattgaagaaagccagcgtacaaaaacaggagtttttggctgtgagcggaattcctaccattgcatcgggggtgatgatccatcaaccaataccgcaagtcctaccagcaaatatggctataaacgtccaaactgttggtggtggtaacattatacacgcacccaatgcggttcatcccatggtgataccaatcatggcccaaccagcccccattcatgcctctgctgcatctttccagcccgcggcttctcccatgccaatctctacatacactccagttccatcgcaatcattcacttccttccagagttctattggctccatacagtcaaatagtgacgtttcgtctatcttctcgaacatgaacattcgtgtaaacactcctcgctctgtgccaaactctccgaatgatggatatttacaccagcaacatatcccacagcagtatcagcatcaaaccgttagcccttctgttgctaagcagcagaagacttttgcaagttctcttgcatctgcattatctaccttacgaaaaagaacgcctgtaagtgccccctccactactatagaatcaccatcttcgccaagtgattcgagtcatacctctgcgtccagcagcgctatctccttacctttcagcaatgctccttctcaacttgccgtggccaaagaacttgagtccgtctatctagattctaataggtacaccaccaagactaggagggaaagagccaagttcgaaattcctcaagagcaagaggaagatacaaacaacagcagtagcagtagcagtaacgaggaggagcacgaatcgcttgatcatgaatccagcaaaagcaggaagaagttgtcaggcgtaaaattgccgcctgtacgtaacctactgaaacaaatcgatgttttcaatggtcctaaaggaatt

SEQ ID NO: 20 - protein, 383 aa, Saccharomyces paradoxus
MPKKQTSFPVDNENRPFRCDTCHRGFHRLEHKKRHLRTHTGEKPHHCAFPGCGKSFSRSDELKRHMRTHTGQSQRRLKKASVQKQEFLAVSGIPTIASGVMIHQPIPQVLPANMAINVQTVGGGNIIHAPNAVHPMVIPIMAQPAPIHASAASFQPAASPMPISTYTPVPSQSFTSFQSSIGSIQSNSDVSSIFSNMNIRVNTPRSVPNSPNDGYLHQQHIPQQYQHQTVSPSVAKQQKTFASSLASALSTLRKRTPVSAPSTTIESPSSPSDSSHTSASSSAISLPFSNAPSQLAVAKELESVYLDSNRYTTKTRRERAKFEIPQEQEEDTNNSSSSSSNEEEHESLDHESSKSRKKLSGVKLPPVRNLLKQIDVFNGPKGI

SEQ ID NO: 21 - DNA, 1146 bp, Saccharomyces mikatae
atgcctaaaaagcaaaccacctttccagtagataacgaaaacagaccttttagatgtgatacctgtcatcgtggtttccatcgtttggaacataaaaagagacacttgagaacacacaccggtgaaaaacctcaccattgcgcatttcctggctgcgggaaaagctttagtagaagcgacgaactgaaaaggcatatgagaacgcatacagggcaatctcaaaggagattgaagaaatccagtgtacagaaacaggaattcttgacagtaagcggtatacctacaattgcatcaggtgtgatgatccatcaaccaataccgcaagttttaccagcaaatatggccatcaacgtgcaaacggttggtggcagtaatattatacatgcccctaatgctgtgcaccctatgatgatacccattatggcgcaaccggctcctatgcatgcctctgcagcatctttccagactgcaacctctccaatgcccatatctacatcatacacgcctgttccatcgcaatctttcacttcctttcagagctccattggctccatacagtcaaatagcgacgtttcatccgttttctcgaacatgaatgttcgtataaacactcctcgctcggtaccaaattctccgaatgacgggtacttgcatcagcaacatgtcccacagcagtatcatcatcagtctactagcccttctgttgctaagcaacagaaaactttcgcaagttctcttgcatcagcattatctacattacagagaagaacacctgtgagtgccacctcgatcacaatggaatcaccatcttcaccaagtgattcctgccatacttcagcatctagcagcgctatctctttaccttttagcagtgctccttctcacctcgccatggccaaagaacttgggtctgtctacctggattctaataggtataccaccaaatccagaagggaaagagctaaatttgaaattcctcaagagaaagaagaagacacaaacaacagcagcagcagcggcaatgaagaggaggagagcgaatcgctaggtcatgaagttagtaaaagcagaaaaaaactgtcaggagtaaaactacctcctgtacgtaacttattgaaacaaatagatgtcttcaatggtccgaaa

SEQ ID NO: 22 - protein, 382 aa, Saccharomyces mikatae
MPKKQTTFPVDNENRPFRCDTCHRGFHRLEHKKRHLRTHTGEKPHHCAFPGCGKSFSRSDELKRHMRTHTGQSQRRLKKSSVQKQEFLTVSGIPTIASGVMIHQPIPQVLPANMAINVQTVGGSNIIHAPNAVHPMMIPIMAQPAPMHASAASFQTATSPMPISTSYTPVPSQSFTSFQSSIGSIQSNSDVSSVFSNMNVRINTPRSVPNSPNDGYLHQQHVPQQYHHQSTSPSVAKQQKTFASSLASALSTLQRRTPVSATSITMESPSSPSDSCHTSASSSAISLPFSSAPSHLAMAKELGSVYLDSNRYTTKSRRERAKFEIPQEKEEDTNNSSSSGNEEEESESLGHEVSKSRKKLSGVKLPPVRNLLKQIDVFNGPK

SEQ ID NO: 23 - DNA, 1149 bp, Saccharomyces kudriavzevii
atgcctaaaaagcaaactaacttcccagtagataatgaaaacagaccatttagatgtgacacctgtcatcgtggttttcatcggttagagcataaaaagagacacttgagaacgcatacgggtgaaaaacctcatcattgtgcatttcctggctgtgggaaaagctttagtagaagcgacgaactaaaaagacacatgagaacacatacgggacaatctcaaaggagactgaagaaatccagcatacagaaacaggattttttgactgtaaatggaattcctacgattgcatcgggaatgataatccaccagccaataccgcaagtccttccggcaaatatggctatcaatatgcaagccgtcggtggcggtaacatcatacacgcgccaaacgcagtgcatcccatgatgataccaatcatggctcattcagcccctatgcacggttctgctgcttcttaccagcccgccacctcacccatgcccctccccacatacactccagccccatcgcaatcgttcacttccttccagagctcccttggttcgatgcaatcaaatagcgatgtatcatcgatcttctcgaatatgaatgctcgtgtaaatacccctcgctcggtgccaaattctccgaatgacggatatttgcatcagcaatacatcccaaagcagcaccagcatcaaactgccagcccttgcatagccaagcaaaacaagacgtttgcaagttcccttgtatctgcattgtctacgttacaaagaagaacccctgtaagtgctacctctaccgcaatagaatctccatcttcaccaagtgattcaagccatacctcagcatgcagtagcgccatttctttaccattcagcaatgctccttctcagctcgccatgggcaaagaattcgatcctgtatatctggattctaatagatataccactaaaaccagaagagaaagagctaaatttgagattcccgaagaacaggaagaggatacaaacaacagcagtagtagcagtagcaacgatgacgagcaggaatcactagttcgtaagtctaggaagggcagaaagaagttgtcaggcattaaactaccgcctgtacgcaacctattgaaacagattgatgtcttcaatggtcccaaggatgtt

SEQ ID NO: 24 - protein, 383 aa, Saccharomyces kudriavzevii
MPKKQTNFPVDNENRPFRCDTCHRGFHRLEHKKRHLRTHTGEKPHHCAFPGCGKSFSRSDELKRHMRTHTGQSQRRLKKSSIQKQDFLTVNGIPTIASGMIIHQPIPQVLPANMAINMQAVGGGNIIHAPNAVHPMMIPIMAHSAPMHGSAASYQPATSPMPLPTYTPAPSQSFTSFQSSLGSMQSNSDVSSIFSNMNARVNTPRSVPNSPNDGYLHQQYIPKQHQHQTASPCIAKQNKTFASSLVSALSTLQRRTPVSATSTAIESPSSPSDSSHTSACSSAISLPFSNAPSQLAMGKEFDPVYLDSNRYTTKTRRERAKFEIPEEQEEDTNNSSSSSSNDDEQESLVRKSRKGRKKLSGIKLPPVRNLLKQIDVFNGPKDV

SEQ ID NO: 25 - DNA, 1155 bp, Saccharomyces bayanus
atgtccaaaaagcaaacgagcttcccagtagataacgaaaacagaccgttcagatgtgatacctgcaaccgcgggttccatcggttggaacataaaaagagacacttgaggacgcacacaggtgaaaagccccaccattgtggatttcctggttgtgggaagagcttcagtagaagcgacgaactgaaaagacacatgagaacgcacacaggacaatcccaaagaagactgaagaaatccggcatacagaagcaagagtacttgaccgtgagcgggatccccaccattgcatcaggaatgatgattcaccaacctataccgcaagtcctgccggcaaacatggccatcaacgtgcaaaccgtcggtggcggcaacatcatccatgccgccaatgcagtgcaccccatgatgataccgatcatggctcaacctgcccccatgcacgcctctgctgcttctttccatcccgcatcctctccgatgcccatccccacatacactccaattccatcgcagtcgttcacttccttccagagctcgcttgggtccatacaatccaacagcgacgtttcgtcgatcttttccaacatgaatgtgcgtataaacactcctcgctcggtgccaaactctccaaatgacggctacctgcagcatcatcatcatccccaacaccaataccagcatcataccgccagtccttccgttgctaagcaacagaagaccttcgcaagttctcttgcctctgcattatccactttacaaagaagaaccccagtgagtgccgccacgcccactatagattcaccatcttcaccaagtgattccagtcatacttccgcgtccagcagcgccatctccttacctttcagcaacgctccttcccagctcaccatggccaaagagctagagtccgtatacctcgattccaataggtacactaccaaaaccagaagagaaagagccaaattcgaaatccccgaagagcaagaagaagatacgaacagcagcagcagcagcagcagcagcagcaatggtgagaaggaatccctaggccataagtctggtaagagcagaaagaagttatccggtatacaattacctcccgtccgcaacctgttgaaacaaatcgatgtcttcaacggtcctaagggagtt

SEQ ID NO: 26 - protein, 385 aa, Saccharomyces bayanus
MSKKQTSFPVDNENRPFRCDTCNRGFHRLEHKKRHLRTHTGEKPHHCGFPGCGKSFSRSDELKRHMRTHTGQSQRRLKKSGIQKQEYLTVSGIPTIASGMMIHQPIPQVLPANMAINVQTVGGGNIIHAANAVHPMMIPIMAQPAPMHASAASFHPASSPMPIPTYTPIPSQSFTSFQSSLGSIQSNSDVSSIFSNMNVRINTPRSVPNSPNDGYLQHHHHPQHQYQHHTASPSVAKQQKTFASSLASALSTLQRRTPVSAATPTIDSPSSPSDSSHTSASSSAISLPFSNAPSQLTMAKELESVYLDSNRYTTKTRRERAKFEIPEEQEEDTNSSSSSSSSSNGEKESLGHKSGKSRKKLSGIQLPPVRNLLKQIDVFNGPKGV

SEQ ID NO: 27 - DNA, 3453 bp, Saccharomyces cerevisiae
atggatcaggataacaacaaccacaatgacagcaataggctgcacccacctgatatacatccaaatttgggccctcaattgtggctgaatagtagcggtgattttgacgacaacaacaacaacaacaacaacaacaacaataataatagcacaagaccacaaatgccatcacgaactagagaaacggcaacttcggaaagaaatgcaagtgaggttagggatgcaacgctaaataatatctttaggttcgatagtattcaacgggaaacgcttttgccaaccaacaacggacaaccgctaaatcaaaacttttcgctgacatttcaaccacaacagcaaacaaatgcgctgaacgggattgacataaacactgtgaacacaaaccttatgaatggtgtcaatgttcaaatagatcaacttaatcgattgttaccgaacctaccagaggaagaacggaagcaaatccacgaattcaagctaatagtgggcaaaaaaatccaagagtttctggttgttatagagaaacgtagaaaaaaaatactgaacgaaattgagctagacaaccttaaactaaaggagctacgtattgataactccccacaagcaattagttatttgcataaattacaaagaatgaggcttagggcgctagagacagaaaacatggaaattagaaatttaaggctaaaaatattaacaattatagaagagtacaaaaagtcattatatgcatactgccattccaagctaagaggtcaacaagtggaaaatccaacagataatttcatcatttggataaactccatagatactactgaatcatctgacttgaaagaagggctacaagatctttcgagatattcaaggcagttcataaataatgtgctttcgaatccatcaaatcaaaacatatgtacgagtgtcacccgaagatcacctgtgtttgccctaaacatgctaccctcggaaatattacacttaatattagataaacttaaccaaaaatatgatattgtaaaattccttaccgtttccaaactctgggctgaaataattgtgaagatactttattacagaccgcacatcaacaaaaagagtcaattagacttgtttttaaggactatgaagttaacttctgaagaaactgtattcaactatcgtttaatgatcaaaagattaaatttttcatttgttggtgactacatgcacgatacagagcttaactattttgtcggatgtaagaatttggagcgactaactttagtattttgcaagcatataaccagtgttccaatatcggctgttttgagaggatgtaaatttctccaaagtgtggatatcactggaataagagacgtttccgatgacgtatttgataccttagcgacatattgtcccagagtacagggcttttatgttcctcaggcaaggaatgtaacattcgattcactgcggaatttcatagtccattccccgatgttgaaaagaataaaaatcacagcaaacaataacatgaatgacgaattagtagaactattagccaacaaatgccctttgcttgtagaggtcgatataacattaagtccaaatgtcactgattctagtttgttaaaactcctcactaggttagttcagctgagggaattcagaataactcataatacgaatattacggataatcttttccaggagctttctaaagtagttgacgatatgccctctttaagattgattgatctttctggatgtgaaaatattacagataaaactatagaaagtatagtcaatttagcccctaaattacgtaatgtttttctaggcaagtgtagccgaattacagatgcatcgttgttccaattatcgaagctgggcaaaaacttgcaaacagtgcattttgggcactgtttcaatataactgataacggggtaagagcactctttcattcatgtacaagaatacagtatgtggactttgcgtgctgtacgaatttaaccaatagaactctttatgaactagcagacttaccaaaattaaagagaattggccttgtcaaatgtacgcaaatgactgacgagggtttgttgaatatggtttccttgcgaggccgaaatgatactttagaaagggtacatttatcttactgttctaatttaacaatatatccgatatatgagcttctaatgtcttgcccaaggctctcacatttgtctttgactgctgttccgtcatttttacgccccgatataacgatgtattgcaggcctgcaccctcagactttagtgaaaatcaacgtcaaatattctgcgtattttcagggaaaggtgttcataaacttcgccattatttagtaaatttaacgtcgcccgcttttggaccacatgtcgatgtaaatgatgttttgacaaaatatattagatccaagaatttgatatttaacggtgaaacacttgaagatgctcttaggagaatcataactgatttaaatcaagattccgctgcaattatagctgctacaggattaaatcaaatcaacggtctaaataacgattttcttttccagaatatcaattttgaacgaatagatgaagtattcagttggtatctcaatacttttgatggcattaggatgagctcggaggaagttaactcactattattgcaagtaaacaagacgttttgtgaagatccatttagtgatgtggacgatgatcaagattatgtcgtagcacctggtgtaaaccgggaaattaacagtgaaatgtgtcatattgttagaaaattccatgagttaaatgatcatattgatgatttcgaggtgaatgttgctagtttggtaagagttcagtttcagtttactggttttttacttcatgaaatgactcaaacctatatgcaaatgattgaattaaacagacaaatttgtttagtacaaaaaacggttcaggaatcgggcaacatagattaccaaaaagggcttttaatatggcgacttttattcattgacaaattcattatggtggttcagaagtacaagctctccaccgttgttttgagactatatttaaaagataacataacattgttaaccagacaaagagaactattaatagcccaccaaagatcagcatggaataacaataatgacaatgacgccaaccggaacgccaacaacatagtgaatattgtatcggatgctggggcaaacgatacaagtaacaatgaaactaacaatggtaatgatgacaatgaaacagaaaatccaaatttctggcgtcagtttggcaatagaatgcaaatatcacctgaccagatgaggaatctccaaatgggacttcgtaatcagaacatggttaggaacaataacaacaacacaattgacgaatcaatgcctgacactgccattgattctcaaatggatgaagcatcaggaacgcccgatgaagatatgtta

SEQ ID NO: 28 - protein, 1151 aa, Saccharomyces cerevisiae
MDQDNNNHNDSNRLHPPDIHPNLGPQLWLNSSGDFDDNNNNNNNNNNNNSTRPQMPSRTRETATSERNASEVRDATLNNIFRFDSIQRETLLPTNNGQPLNQNFSLTFQPQQQTNALNGIDINTVNTNLMNGVNVQIDQLNRLLPNLPEEERKQIHEFKLIVGKKIQEFLVVIEKRRKKILNEIELDNLKLKELRIDNSPQAISYLHKLQRMRLRALETENMEIRNLRLKILTIIEEYKKSLYAYCHSKLRGQQVENPTDNFIIWINSIDTTESSDLKEGLQDLSRYSRQFINNVLSNPSNQNICTSVTRRSPVFALNMLPSEILHLILDKLNQKYDIVKFLTVSKLWAEIIVKILYYRPHINKKSQLDLFLRTMKLTSEETVFNYRLMIKRLNFSFVGDYMHDTELNYFVGCKNLERLTLVFCKHITSVPISAVLRGCKFLQSVDITGIRDVSDDVFDTLATYCPRVQGFYVPQARNVTFDSLRNFIVHSPMLKRIKITANNNMNDELVELLANKCPLLVEVDITLSPNVTDSSLLKLLTRLVQLREFRITHNTNITDNLFQELSKVVDDMPSLRLIDLSGCENITDKTIESIVNLAPKLRNVFLGKCSRITDASLFQLSKLGKNLQTVHFGHCFNITDNGVRALFHSCTRIQYVDFACCTNLTNRTLYELADLPKLKRIGLVKCTQMTDEGLLNMVSLRGRNDTLERVHLSYCSNLTIYPIYELLMSCPRLSHLSLTAVPSFLRPDITMYCRPAPSDFSENQRQIFCVFSGKGVHKLRHYLVNLTSPAFGPHVDVNDVLTKYIRSKNLIFNGETLEDALRRIITDLNQDSAAIIAATGLNQINGLNNDFLFQNINFERIDEVFSWYLNTFDGIRMSSEEVNSLLLQVNKTFCEDPFSDVDDDQDYVVAPGVNREINSEMCHIVRKFHELNDHIDDFEVNVASLVRVQFQFTGFLLHEMTQTYMQMIELNRQICLVQKTVQESGNIDYQKGLLIWRLLFIDKFIMVVQKYKLSTVVLRLYLKDNITLLTRQRELLIAHQRSAWNNNNDNDANRNANNIVNIVSDAGANDTSNNETNNGNDDNETENPNFWRQFGNRMQISPDQMRNLQMGLRNQNMVRNNNNNTIDESMPDTAIDSQMDEASGTPDEDML

SEQ ID NO: 29 - DNA, 1710 bp, Saccharomyces cerevisiae
atgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgcctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccggtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcttctgttggtgtcactagattatggccaaatggtcaaaacaacggctcatccaagggtgctggtaactgtatgatctgttttgcctgtttctatatcttttgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaa

SEQ ID NO: 30 - protein, 570 aa, Saccharomyces cerevisiae
MNSTPDLISPQKSNSSNSYELESGRSKAMNTPEGKNESFHDNLSESQVQPAVAPPNTGKGAYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEAGVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQNNGSSKGAGNCMICFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 31 - DNA, 1623 bp, Saccharomyces cerevisiae
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaa

SEQ ID NO: 32 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 33 - DNA, 1701 bp, Saccharomyces cerevisiae
atgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaa

SEQ ID NO: 34 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 35 - DNA, 1728 bp, Saccharomyces cerevisiae
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttgggttccaccaaacaagagaggtactgactacaacgctgatgatctaatgcatgatgatcaaccattttacaagaagatgttcggaaaaaag

SEQ ID NO: 36 - protein, 576 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWVPPNKRGTDYNADDLMHDDQPFYKKMFGKK

SEQ ID NO: 37 - DNA, 1776 bp, Saccharomyces cerevisiae
atgtcggaacttgaaaacgctcatcaaggccccttggaagggtctgctactgtgagcacaaattctaactcatacaacgagaagtcaggaaactcgactgctcctggtaccgccggttacaacgataatttggcacaagctaaacccgtctcaagttacatttcccatgaaggccctcccaaagacgaactggaagagcttcagaaggaggttgacaaacaactagagaagaaatcgaagtcggatttactatttgtatccgtctgctgtttgatggttgcttttggtgggttcgtgtttgggtgggatactggtactatatctggttttgtcaggcaaacagacttcattaggcgatttggcagcacccgtgcaaacgggactacctatctttccgatgtcagaaccggtttgatggtttctattttcaacatcggctgcgctatcggaggtatagttttgtcaaagctcggtgatatgtatggacgtaagattggtctgatgactgttgtcgtcatttactcaattgggatcatcatccaaatcgcctccattgacaaatggtatcaatatttcattggaagaatcatctcaggactgggcgttggtggtattacagttttggcgcctatgctaatttctgaagtgtcgcctaagcagttgcgtggtactctggtttcatgttaccaattaatgatcactttcggtatctttttgggatattgtactaattttggtaccaagaattactcaaactctgtccaatggagggtaccattaggcttatgctttgcatggtctatttttatgattgttggtatgacgttcgttcctgaatccccacgttatctggtagaagtgggaaaaattgaagaggccaagcggtccttagcaagagctaacaaaaccactgaagactctcctttagtaactttagaaatggagaactatcagtcttctattgaagctgagagattggcgggctctgcttcttggggggaattggttactggtaagccccagatgttcagacgtacactaatgggtatgatgattcaatctttacaacagctgacaggtgacaattacttcttttactatggtactacaattttccaggctgttggtttggaagattcatttgaaactgctattgttttgggtgttgttaattttgtttcgacttttttctcgctatataccgtcgatcgttttggtcgtcgtaattgtttgttatggggctgtgtaggtatgatttgttgctatgtcgtctatgcctctgttggtgttaccagattatggccaaacggtcaagatcaaccatcttcaaagggtgctggtaactgtatgattgttttcgcatgtttctacattttctgtttcgctaccacttgggcccccgttgcctatgtccttatctctgagtcgtatcccttaagagtacgtggtaaagcaatgtcgattgcaagtgcctgtaactggatttgggggttcttgatcagttttttcactccatttattacttcagcaatcaatttctattatggctatgtctttatgggttgtatggtgttcgcatacttttatgtgttcttctttgttccagagacaaagggcttaacattagaagaagtcaacgaaatgtatgaagaaaatgtgctaccttggaagtctaccaaatggatcccaccatctaggagaacaacagattatgacctagacgctactagaaatgatccgagaccattttataaaaggatgttcactaaagaaaaa

SEQ ID NO: 38 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 39 - DNA, 1710 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaaatcgaagctgtcttggctggtgtagaggcagagaaattagctggtaatgcatcctggggtgaattgtttagtagcaagacaaaggtccttcaacgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaa

SEQ ID NO: 40 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEIEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 41 - DNA, 1710 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaa

SEQ ID NO: 42 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 43 - DNA, 1458 bp, Saccharomyces cerevisiae
atggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgct

SEQ ID NO: 44 - protein, 486 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 45 - DNA, 1452 bp, Saccharomyces kluyveri
atggttcatttaggtccaaagaaaccacctgccagaaagggctccatggctgatgtcccaagaactctgatggatcaactaaagggtcttgaaactattttcggtgtctctggtgaaaaattgaaagctatcaccaagcactttatctccgaattgaacaaaggtttgtccaagaagggtggtaacattccaatgattccaggttgggttatggaattcccaactggtaaggaatctggtgactacttggctattgacttgggtggtaccaacttgagagttgtcttggtcaagctaggtggtaaccgtgactttgacactacccaatccaagtacaagttgccagaccacatcagaacctccagtgctgatgaactgtggtccttcattgccgactgtttgaagatttttgtcgacgaacaatacccagaaggtgttactgaacctctaccattaggtttcaccttctcttaccctgcctcccaagacaagatcaacgaaggtgtcttgcaaagatggactaagggtttcgacatcgaaggtgttgaaggtaaggatgttgttccaatgcttcaagaacaattgaagaagagaaacattccaattgatgttgtcgctttaatcaacgacaccactggtactctagtcgcttctatgtacaccgattcagaaaccaagatgggtgttatctttggtaccggtgtcaatggtgcttactacgatgtttgctctgatatcgaaaagttgcaaggtaggttgccagaagacattccaaatagctctccaatggccatcaactgtgaatacggttctttcgataacgaacacatgattctaccaagaaccaagtacgacgttatcgttgatgaagaatctccaagaccaggtcaacaaagtttcgaaaagatgacctccggttactacttgggtgaattgctacgtttggttctgttggacctataccaacaaggtatggtctttgaaggtcaagatatcaccaagttgaaaaaggcctacgttatggatacttcttacccagctaagatcgaagaagatccattcgaaaacttggaagacacctatgaactattcaagtctgacttgggtatcgaaaccactattccagaacgtaaattgattagacgcttatgtgaattgatcggtactagagccgctagattgtctgtttgtggtatcgctgccatttgccaaaagagaggttacgaatctgctcatattgctgctgatggttccgtctttaacaaatacccaggtttcaaggaaagagctgctgccgcattgagagatatttatgactgggaagtctctccaaaggactatccaatcactattgttgctgctgaagatggttctggtgctggtgccgctatcatcgctgctttgactcaaaagagactagcagccggtaaatctgttggtgtttctggtgct

SEQ ID NO: 46 - protein, 484 aa, Saccharomyces kluyveri
MVHLGPKKPPARKGSMADVPRTLMDQLKGLETIFGVSGEKLKAITKHFISELNKGLSKKGGNIPMIPGWVMEFPTGKESGDYLAIDLGGTNLRVVLVKLGGNRDFDTTQSKYKLPDHIRTSSADELWSFIADCLKIFVDEQYPEGVTEPLPLGFTFSYPASQDKINEGVLQRWTKGFDIEGVEGKDVVPMLQEQLKKRNIPIDVVALINDTTGTLVASMYTDSETKMGVIFGTGVNGAYYDVCSDIEKLQGRLPEDIPNSSPMAINCEYGSFDNEHMILPRTKYDVIVDEESPRPGQQSFEKMTSGYYLGELLRLVLLDLYQQGMVFEGQDITKLKKAYVMDTSYPAKIEEDPFENLEDTYELFKSDLGIETTIPERKLIRRLCELIGTRAARLSVCGIAAICQKRGYESAHIAADGSVFNKYPGFKERAAAALRDIYDWEVSPKDYPITIVAAEDGSGAGAAIIAALTQKRLAAGKSVGVSGA

SEQ ID NO: 47 - DNA, 1458 bp, Saccharomyces bayanus
atggttcatttaggtccaaaaaaaccacaagccagaaagggctccatggccgacgtgccaaaggaattgatgcaacaaattgaaaatttcgaacaaatcttcactatttcatctgaaagcctacaaactgtcaccaaacatttcatttccgaattggaaaagggtctatccaagaagggtggtaacattccaatgattcctggttgggttatggacttcccaactggtaaggaatctggtgatttcttggccattgatttgggtggtaccaacttgagagttgttttggtcaaattgggtggtgaccgtactttcgacaccacccaatccaagtatagattaccagatgctatgagaactactcaaaactcagaagaattatgggaatttattgctgattccttaaagacttttatcgatgaacaattcccagaaggtatttctgagccaattcctttaggtttcaccttttccttcccagcttcccaaaacaagatcaacgaaggtgttttgcaaagatggactaagggtttcgacattccaaacattgaaaaccacgatgtcgttccaatgttgcaaaagcaaatcaccaagagaaacatcccaattgaagttgttgctttgattaacgatactactggtactttggttgcttcttactacacagacccagaaaccaagatgggtgtcattttcggtactggtgtcaatggtgcttactacgacgtttgtggcgaaatcgaaaaactacaaggaaagttgtctgatgacattccacaatcagccccaatggctatcaattgtgaatatggttctttcgataacgaacacgttgtcttgccaagaaccaagtacgacatcactattgatgaagaatctccaagaccaggccaacagacttttgaaaagatgtcttctggttactacttgggtgaaatcttgcgtttggccttgatggacatgtacaagcaaggtttgatcttcaagaaccaagatgtgtctaaattcgacaaggctttcgttatggacacttcttacccagctagaattgaagaagacccattcgaaaacttggaagacactgatgacttgttccaaaacgaattcggtatctccacctccgtccaagaacgtaagttgatcagacgtttatctgaattgattggtactagagctgctagattatccgtttgtggtattgctgccatctgtcaaaagagaggttacaaaaccggtcatattgccgctgatggttccgtttacaacagatacccaggcttcaaggaaaaggctgctgctgctttgaaggacatctatggctggaccgcagcttccccagaagactacccaatcaagattgtccctgctgaagacggttccggtgctggtgccgctgttattgctgctttggctgaaaagagaattgctgaaggcaaatctgttggtataatcggtgct

SEQ ID NO: 48 - protein, 486 aa, Saccharomyces bayanus
MVHLGPKKPQARKGSMADVPKELMQQIENFEQIFTISSESLQTVTKHFISELEKGLSKKGGNIPMIPGWVMDFPTGKESGDFLAIDLGGTNLRVVLVKLGGDRTFDTTQSKYRLPDAMRTTQNSEELWEFIADSLKTFIDEQFPEGISEPIPLGFTFSFPASQNKINEGVLQRWTKGFDIPNIENHDVVPMLQKQITKRNIPIEVVALINDTTGTLVASYYTDPETKMGVIFGTGVNGAYYDVCGEIEKLQGKLSDDIPQSAPMAINCEYGSFDNEHVVLPRTKYDITIDEESPRPGQQTFEKMSSGYYLGEILRLALMDMYKQGLIFKNQDVSKFDKAFVMDTSYPARIEEDPFENLEDTDDLFQNEFGISTSVQERKLIRRLSELIGTRAARLSVCGIAAICQKRGYKTGHIAADGSVYNRYPGFKEKAAAALKDIYGWTAASPEDYPIKIVPAEDGSGAGAAVIAALAEKRIAEGKSVGIIGA

SEQ ID NO: 49 - DNA, 1458 bp, Saccharomyces mikitae
atggttcatttaggtccaaagaaaccacaagccagaaagggctccatggctgatgtgccaaaggagttgatgcaacaaattgaaaatttcgaaaaaatgttcactgtttcatctgagaccctacaaaccgtgactaagcatttcattactgaattggaaaagggtttgtccaagaagggtggtaacatcccaatgattccaggttgggttatggacttcccaactggtaaagaatccggtgatttcttggccattgatttgggtggtaccaacttgagagttgtgttggtcaaattgggtggtgatcgtacctttgacactacacaatctaagtacagattaccagatgctatgagaactactcaaaacccagatgaattatgggaatttattgcagattctttgaaggctttcattgatgaacaattcccaaaaggtatctcggaaccaattccattgggtttcaccttttccttccctgcttcccaaaataaaatcaatgaaggtatcttgcaaagatggactaaaggtttcgatattccaaacattgaaaaccacgatgttgttcctatgttgcaaaagcaaatcaccaagagaaacatcccaattgaagttgttgctttgataaacgacactacaggtactttggttgcttcttactacactgatccagaaaccaagatgggtgtcattttcggtactggtgtcaatggtgcttactacgatgtttgttccgacatcgaaaaactacaaggaaaattatctgatgacattccaccatcagctccaatggccattaactgtgaatatggttctttcgacaacgagcacgtcgtgttgccaagaactaaatacgacatcaccattgatgaggaatctccaagaccaggtcaacaaacttttgaaaaaatgtcttctggttactacttgggtgaaattttacgtttggccttgatggatatgtataagcaaggtttcatcttcaagaaccaagacttaactaaattcgacaagccattcgtcatggacacttcttacccagccagaattgaagaagatccatttgaaaacttggaagatacagatgatttgttccagaacgagttcggcatcaacaccaccgttcaagaacgtaaattaattagacgtttatctgaattaattggtactagagccgctagattgtctgtctgtggtattgctgccatctgtcaaaagagaggttacaagaccggtcacatcgctgccgatggttctgtttacaacagatacccaggtttcaaagaaaaggctgccaatgcgttgagagacatttacggttggacccaaacctcgctagacgagtacccaatcaagattgttcctgctgaagatggttctggtgctggtgccgctgttattgctgctctagccgagaagagaattgctgaaggtaagtctgttggtatcatcggtgct

SEQ ID NO: 50 - protein, 486 aa, Saccharomyces bayanus
MVHLGPKKPQARKGSMADVPKELMQQIENFEKMFTVSSETLQTVTKHFITELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPKGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLTKFDKPFVMDTSYPARIEEDPFENLEDTDDLFQNEFGINTTVQERKLIRRLSELIGTRAARLSVCGIAAICQKRGYKTGHIAADGSVYNRYPGFKEKAANALRDIYGWTQTSLDEYPIKIVPAEDGSGAGAAVIAALAEKRIAEGKSVGIIGA

SEQ ID NO: 51 - DNA, 1458 bp, Saccharomyces paradoxus
atggttcatttaggtccaaaaaaaccacaagccagaaagggctccatggctgatgtgccaaaggaattgatgcaacaaattgaaaatttcgaaaaaatttttactgttccaactgaaaccctacaagctgttaccaagcatttcatttcggaattggaaaagggtttatccaagaagggtggtaacatcccaatgattccaggttgggttatggatttcccaactggtaaagagtctggtgatttcttggccattgatttgggtggtaccaacttgagagttgtcttggtcaaattgggcggtgaccgtacctttgacaccacccaatctaagtacagattacctgatgctatgagaactactcaaaatccagacgaattatgggaatttattgctgactctttgaaggcttttattgatgagcaattcccacaaggtatctcagaaccaattccattgggtttcaccttttctttcccagcttctcaaaacaaaatcaatgaaggtatcttgcaaagatggactaagggttttgatattccaaacattgaaaaccacgatgttgtcccaatgttgcaaaagcaaatcaccaagagaaacatcccaattgaagttgttgctttgataaacgacactacaggtactttggttgcttcgtactacaccgacccagaaaccaagatgggtgttattttcggtactggtgtcaatggtgcttactacgatgtttgttccgacatcgaaaagctacaaggaaaactatctgatgacattccaccatcagctccaatggctatcaactgtgaatatggttccttcgataacgaacatgtcgtcttgccaagaaccaaatatgatatcaccatcgatgaagaatctccaagaccaggtcaacaaacctttgaaaaaatgtcttctggttactacttgggtgaaattttgcgtttggctttgatggacatgcaaaagcaaggcttcattttcaagaaccaagacttgtccaagttcgacaaacctttcgtcatggacacttcttacccagccagaattgaagaagatccatttgaaaacttagaagatactgacgacttgttccaaaacgagttcggtattaacaccactgttcaagaacgtaaattgattagacgtttatctgaattgattggtgctagagccgctagattgtccgtttgtggtattgctgctatctgtcaaaagagaggttacaagaccggccacatcgctgcagatggttccgtttacaacagatacccaggtttcaaagaaaaggctgccaatgctttgaaggacatttacggctggactcaaacctcactagacgactacccaatcaaaattgttcctgctgaggatggttctggtgctggtgccgctgttattgctgctttagcccaaaagagaattgctgaaggtaagtctgttggtatcatcggtgct

SEQ ID NO: 52 - protein, 486 aa, Saccharomyces paradoxus
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMQKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 53 - DNA, 1458 bp, Zygosaccharomyces rouxii
atggttcatttaggtccaaaaaaaccacccgcaagaaagggttctatggctgacatgccacaagaccttttagatcaagttcgtggtctagaagttatcttctcagtctcaactgaaaaattgagagctgttacaaagcatttcattgatgaactacaaaaaggtttgtccaagaagggtggtaacatcccaatgattccaggatgggtcctagaatacccaactggtaaggaaaccggtaactacttggctatcgatttgggtggtaccaacctaagagttgttttggttaagttaaatggtgaccgtacttttgattcttctcaatccaagtacaaattgcctcaccacatgagaaccactagaaaccctaaggatctattcgacttcatcgcttcaagtttgaagaactttatcgaagaagagttcccaaatggatgtgaagacactcttccattgggtttcaccttttcttacccagcatcccaaggtaagattaacgaaggtgttctacagagatggactaagggtttcgatattccaggtgtggaaggtcatgatgtcgtgcctatgttgcaagagtctctaagtgaaaagggtgtgccaattaatgttgttgccttgattaacgatactaccggtactctagttgcatctcactatactgacccagagactcagatgggtgttatcttcggtactggtgttaacggtgcttactacgatgtctgtaaggacattgaaaaattgcaaggccaattgcctgaagatatcactcctgacaccctaatgggtatcaactgtgaatacggttcattcgataacgaacatgtggttttgccaagaaccaaatacgatgtcatcgtcgatgaagaatccccaagacctggtcaacaatcttttgaaaagatgtcatcaggttactacttgggtgaaatcatccgtttagttttgattgacttacatgaacagggtttcatcttcaaggaccaagatgttagcaagttgagagaaccttacgtcatggatacttcttacccatccatgattgaagaagatccatttgaaaacttggaagacactttcgatcttttccaaaaggatttgggcatcactaccactactcctgaacgtaagttgatcagacgtctatgtgagttgatcggtactagagccgccagattatctgtttgtggtatcgcagctatctgtcaaaagagaggctacaagactgctcacattgctgctgatggttccgtcttcaacaagtaccctggtttcaaggaaagagctgcagctgctttgaacgacatctatggatggggtattgaagatcgtcacaagcaaccaatccagattgtcgccgccgaagatggttccggtgctggtgcagcaatcatcgctgctttgactcagcagagacttgctgccaacaaatctgttggtgtcattggcaaa

SEQ ID NO: 54 - protein, 486 aa, Zygosaccharomyces rouxii
MVHLGPKKPPARKGSMADMPQDLLDQVRGLEVIFSVSTEKLRAVTKHFIDELQKGLSKKGGNIPMIPGWVLEYPTGKETGNYLAIDLGGTNLRVVLVKLNGDRTFDSSQSKYKLPHHMRTTRNPKDLFDFIASSLKNFIEEEFPNGCEDTLPLGFTFSYPASQGKINEGVLQRWTKGFDIPGVEGHDVVPMLQESLSEKGVPINVVALINDTTGTLVASHYTDPETQMGVIFGTGVNGAYYDVCKDIEKLQGQLPEDITPDTLMGINCEYGSFDNEHVVLPRTKYDVIVDEESPRPGQQSFEKMSSGYYLGEIIRLVLIDLHEQGFIFKDQDVSKLREPYVMDTSYPSMIEEDPFENLEDTFDLFQKDLGITTTTPERKLIRRLCELIGTRAARLSVCGIAAICQKRGYKTAHIAADGSVFNKYPGFKERAAAALNDIYGWGIEDRHKQPIQIVAAEDGSGAGAAIIAALTQQRLAANKSVGVIGK

SEQ ID NO: 55 - DNA, 1458 bp, Candida glabrata
atggttcatctaggtccaaagaagccaccaacgagaaagggttccatggtggacatgccacaacaacttctagatcaaatcaaggtctttgaagaaatgtacactgttgatggtgaaactttgagaaaggttacaaagcacttcattacagaacttgacaagggtttgtctaaaaagggtggtaacattcctatgattccaggttgggttatggaatacccatctggtaaggaaaagggtgactacttggccattgacttgggtggaaccaacttgagagttgttttggttaagttgggtggtgaccgtacttttgacactactcagtctaagtacaagctaccagaagctatgagaacaactaagaatcatgaagaactatggagtttcattgctgattctctacaagcattcttggaagatcaattcccagaaggtgtcaagggtaagctacctttgggtttcaccttctcttacccagcttctcaagatagaattaaccaaggtgttctacaaagatggactaagggtttcgatattccaaacgtcgaaggtcatgacgtcgttccaatgctacaaaagcaaatcgaaaagagaaacttgccaatcgacatcgttgccttgattaacgatactactggtaccttagttgcatcattgtacactgatggtgaaactaaaatgggtgttatcttcggtactggtgtcaatggtgcttactacgatgttgtttctgatattccaaagttggaaggtaagttggctgatgatattccaaatgattcaccaatggctatcaactgtgaatatggttctttcgataacgaacacgttgttttgccaagaaacaagtatgacttgatcattgatgaagaatctccaagaccaggccaacaagcctttgaaaagatgtcttcaggttattacttgggtgaaatgttgcgtctagctctgttggacctatacgatcaaggtttgattttgaagggtcaagacatttctaagttgaagaagccatacgtaatggatacttcttacccatccaagattgaagacgatccatttgaaaacttggaagacactgacgaacttctacaaaagaacctgggtattcaaaccacagtccaagaacgtaagttgattagacgtctgtgtgaattgattggtactagatctgctagattgtctgtctgtggtattgctgccatctgtcaaaagagaggttacgaaaccgctcacattgctgccgatggttccgttttcaagatgtacccaggcttcaaggagaaggctgctcaaggtttggctgatatttacggttgggaacataaagatccaaaggattgtccaattgtcattgttgatgctgaagatggttctggtgctggtgccgccatcattgctgctttggctgaaaagagaattgctgagggtaagtccttgggtgtcttgggtgct

SEQ ID NO: 56 - protein, 486 aa, Candida glabrata
MVHLGPKKPPTRKGSMVDMPQQLLDQIKVFEEMYTVDGETLRKVTKHFITELDKGLSKKGGNIPMIPGWVMEYPSGKEKGDYLAIDLGGTNLRVVLVKLGGDRTFDTTQSKYKLPEAMRTTKNHEELWSFIADSLQAFLEDQFPEGVKGKLPLGFTFSYPASQDRINQGVLQRWTKGFDIPNVEGHDVVPMLQKQIEKRNLPIDIVALINDTTGTLVASLYTDGETKMGVIFGTGVNGAYYDVVSDIPKLEGKLADDIPNDSPMAINCEYGSFDNEHVVLPRNKYDLIIDEESPRPGQQAFEKMSSGYYLGEMLRLALLDLYDQGLILKGQDISKLKKPYVMDTSYPSKIEDDPFENLEDTDELLQKNLGIQTTVQERKLIRRLCELIGTRSARLSVCGIAAICQKRGYETAHIAADGSVFKMYPGFKEKAAQGLADIYGWEHKDPKDCPIVIVDAEDGSGAGAAIIAALAEKRIAEGKSLGVLGA

SEQ ID NO: 57 - DNA, 1458 bp, Candida glabrata
atggttcatttaggtccaaaaaagccacctgctagaaagggttctatggttgacatgccaaaggatcttcttgatgagatcaagaagttcgaggacatgttctccgttgacgctgccactttgcaaaaagtcaccaagcacttcatcagcgaattgtccaagggtttgtccaaggaaggtggtaacatccctatgatcccagcctgggttatggaaaacccaactggtaaggagaaaggtgacttcttggccattgacttgggtggtaccaacttgagagttgtcctagtcaagctaggtggtgaccgtactttcgacaccactcagtccaagtacaagttgcctggtcctatgagaaccaccaaggacccagaagaaatctggagcttcatcgctgattccttggagaccttcatcaaggagcaattcccagagggttgcaacgagactctgccattgggtttcactttctccttcccagcttcccaggacaagatcaaccaaggtgtcttgcaaagatggaccaagggtttcgacatcccaaacattgaaggccacgatgttatcccaatgttgcaaaagcaaatcgaaaagagaaacttgccaattgacattgtcgctttgatcaacgacactaccggtactttggttgcctccttgtacaccgatggtgaaaccaagatgggtgtcatcttcggtaccggtgtcaacggtgcttactacgatgtcgtctctgacattccaaagctggaaggtaagcttgccgacgatatcccatcttcttccttgatggccatcaactgtgagtacggttccttcgacaacgaacacgtcgtcttgccaagaaacaagtacgatatcgccatcgatgaagaatccccaagaccaggtcaacaaactttcgaaaagatgtcctccggttactacttgggtgaactgctacgtctagcccttttggacctatacaaccaaggtttgatcttcaagggccaagacgtccaaaagttgaaggaagcttacatcatggacacttcttacccatccagaatcgaagacgatcctttcgaaaacttggaagacactgacgaattgttccaagctgacttgggtatccaaactactgtccaagaacgtaagttgatcagacgcctgtgtgaattgatcggtaccagatctgctagattgtccgtctgtggtatcgctgccatctgtcaaaagagaggctacgaaaccgcccacattgctgctgacggttccgtcttcaacaagtacccaggcttccaacaaagagctgccgaaggtttgagagacatttacggctggaaggaagacaagccacaaaactacccaattgtcatcgtcgctgccgaggatggttctggtgctggtgccgctattattgctgccttggcccaaaagagaatcgctgaaggtaagtctttgggtgttattggtgct

SEQ ID NO: 58 - protein, 486 aa, Candida glabrata
MVHLGPKKPPARKGSMVDMPKDLLDEIKKFEDMFSVDAATLQKVTKHFISELSKGLSKEGGNIPMIPAWVMENPTGKEKGDFLAIDLGGTNLRVVLVKLGGDRTFDTTQSKYKLPGPMRTTKDPEEIWSFIADSLETFIKEQFPEGCNETLPLGFTFSFPASQDKINQGVLQRWTKGFDIPNIEGHDVIPMLQKQIEKRNLPIDIVALINDTTGTLVASLYTDGETKMGVIFGTGVNGAYYDVVSDIPKLEGKLADDIPSSSLMAINCEYGSFDNEHVVLPRNKYDIAIDEESPRPGQQTFEKMSSGYYLGELLRLALLDLYNQGLIFKGQDVQKLKEAYIMDTSYPSRIEDDPFENLEDTDELFQADLGIQTTVQERKLIRRLCELIGTRSARLSVCGIAAICQKRGYETAHIAADGSVFNKYPGFQQRAAEGLRDIYGWKEDKPQNYPIVIVAAEDGSGAGAAIIAALAQKRIAEGKSLGVIGA

SEQ ID NO: 59 - DNA, 1365 bp, Schizosaccharomyces pombe
atggaggctaattttcaacaagctgttaaaaagttagtcaatgactttgaataccctaccgagtccttgagagaggccgttaaggagtttgacgaattacgtcaaaagggtttacaaaagaatggtgaggtgcttgctatggctcctgcctttatctctacccttcccaccggcgctgaaactggtgacttcttggcccttgactttggtggtaccaacttgcgtgtttgttggatccaacttctcggtgacggcaagtatgagatgaagcacagcaagtccgtcttgccccgtgaatgcgttcgtaacgagtctgttaagcccatcattgactttatgagtgaccatgttgagcttttcatcaaggagcacttcccttccaagtttggctgccctgaggaggaataccttcctatgggtttcaccttttcttatcccgccaaccaagtttccatcaccgagagctacttgcttcgttggaccaagggtcttaacattcctgaggccatcaacaaggactttgcccaatttttgactgaaggtttcaaggctcgtaaccttcctattagaatcgaggctgtcatcaacgataccgtcggtactctcgttacccgtgcttatacttcaaaggagagcgacacctttatgggtatcattttcggaaccggtaccaacggtgcttacgtcgagcaaatgaaccaaattcccaagcttgctggcaagtgtactggtgatcatatgcttatcaacatggaatggggagcaactgatttctcttgccttcactccactcgttatgatttacttcttgatcatgatactcccaatgctggtcgtcaaatctttgagaagcgcgttggtggtatgtatctcggtgagcttttccgccgtgccttattccacttgatcaaggtttacaacttcaacgaaggtattttccctccttccattactgatgcttggtctttggaaacttctgttctttccagaatgatggttgaacgttctgctgagaatgttcgtaacgttcttagtacattcaagttccgtttccgcagcgacgaagaggctttgtacctttgggatgctgctcatgcaattggccgtcgtgctgctcgtatgtctgccgttcccattgcttctttgtatctttctaccggccgcgctggtaagaagagtgatgttggtgttgatggttctttagtcgaacactatcctcactttgttgacatgctccgtgaagccttgcgtgagcttatcggtgataacgaaaaattgatttccattggtattgccaaggatggcagtggtattggtgccgctctttgcgccctccaagctgttaaggaaaagaaaggcttggcc

SEQ ID NO: 60 - protein, 455 aa, Schizosaccharomyces pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 61 - DNA, 1689 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 62 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 63 - DNA, 1689 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 64 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 65 - DNA, 1599 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 66 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 67 - DNA, 1692 bp, Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 68 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 69 - DNA, 1788 bp, Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 70 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 71 - DNA, 1707 bp, Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 72 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 73 - DNA, 1689 bp, Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaac

SEQ ID NO: 74 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 75 - DNA, 1713 bp, Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtt

SEQ ID NO: 76 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 77 - DNA, 1713 bp, Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaa

SEQ ID NO: 78 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 79 - DNA, 1689 bp, Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 80 - protein, 563 aa, Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 81 - DNA, 1680 bp, K. pneumoniae
atggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 82 - protein, 559 aa, K. pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 83 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 84 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 85 - DNA, 1665 bp, Lactococcus lactis
atgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattga

SEQ ID NO: 86 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 87 - DNA, 1665 bp, Staphylococcus aureus
  CDS (1)..(1665)
atgactgataaaaagtacactgcagccgatatggttattgatactttgaaaaataatggggtagaatatgtttttggtattccgggtgcaaagatagactatctatttaatgctttaattgatgatggtcctgaacttattgtcactcgtcatgaacaaaatgctgcaatgatggcacaaggtattggaagattaacaggtaaaccgggtgtagtacttgttacaagtggccctggtgtaagtaatttaacgactggactattaacagctacatctgaaggggatcctgtattagcgttaggtggccaagtgaaacgtaatgatttattacgattaacgcatcaaagtattgataatgctgcgctattaaaatattcatcaaaatacagtgaagaagtacaagatcctgaatcattatcagaagttatgacaaatgcaattcgaattgctacttcaggaaaaaatggcgcaagttttattagtattccgcaagacgttatttcttcaccagttgaatctaaagctatatcactttgccaaaaaccaaatttaggagtaccgagtgaacaagatattaatgatgtcattgaagcgattaaaaatgcatcatttcctgttttattagctggtatgagaagttcaagtgcagaagaaacaaatgccattcgcaaattagttgagcgcacgaatttaccagttgtagaaacattccaaggtgcaggtgtaattagtcgtgaattagaaaatcatttcttcggtcgtgtgggcttattccgcaatcaagttggtgatgaattattacgtaaaagtgatttagttgttacaatcggttatgatccaattgaatacgaagctagtaactggaataaagaattagaaacacaaattatcaatattgacgaagttcaagctgaaattactaattatatgcaaccgaaaaaagagttgattggtaatattgctaaaacgattgaaatgatttctgaaaaagtggatgagccatttataaatcaacaacatttagacgaattagaacaattaagaacacatattgatgaagaaactggtattaaagcgacgcatgaagaaggaattctacatccagtggaaattattgaatctatgcaaaaggtattaactgatgatactactgtaacagttgatgttggaagtcactatatttggatggcacgtaatttcagaagttacaatccaagacatttattatttagcaatggtatgcaaacgcttggtgtagcattaccgtgggcaatttcagctgcacttgtgcgccctaatacgcaagttgtgtccgttgctggcgatggtggctttttattttcatcacaagatttagaaacggccgtacgtaaaaatttaaatatcatccagcttatttggaatgatggaaaatataacatggttgaattccaagaagaaatgaaatataaacgttcgtcaggtgtagacttcggtcctgtagattttgtaaaatatgcagaatcatttggcgcgaaaggtttacgagttactaatcaagaagaattagaagcggcaattaaagagggctatgaaacagatggtccagtattaattgatatacctgtaaattacaaagataatatcaaactttcaacaaatatgttacctgacgtatttaactaa

SEQ ID NO: 88 - protein, 554 aa, Staphylococcus aureus
MTDKKYTAADMVIDTLKNNGVEYVFGIPGAKIDYLFNALIDDGPELIVTRHEQNAAMMAQGIGRLTGKPGVVLVTSGPGVSNLTTGLLTATSEGDPVLALGGQVKRNDLLRLTHQSIDNAALLKYSSKYSEEVQDPESLSEVMTNAIRIATSGKNGASFISIPQDVISSPVESKAISLCQKPNLGVPSEQDINDVIEAIKNASFPVLLAGMRSSSAEETNAIRKLVERTNLPVVETFQGAGVISRELENHFFGRVGLFRNQVGDELLRKSDLVVTIGYDPIEYEASNWNKELETQIINIDEVQAEITNYMQPKKELIGNIAKTIEMISEKVDEPFINQQHLDELEQLRTHIDEETGIKATHEEGILHPVEIIESMQKVLTDDTTVTVDVGSHYIWMARNFRSYNPRHLLFSNGMQTLGVALPWAISAALVRPNTQVVSVAGDGGFLFSSQDLETAVRKNLNIIQLIWNDGKYNMVEFQEEMKYKRSSGVDFGPVDFVKYAESFGAKGLRVTNQEELEAAIKEGYETDGPVLIDIPVNYKDNIKLSTNMLPDVFN

SEQ ID NO: 89 - DNA, 1698 bp, Listeria monocytogenes
  CDS (1)..(1698)
atggcgaaactagaaaaagaccaagaaaaagtaataacacaagggaaatcaggagcggatttagttgtagacagcttaattaatcaaggtgttacgcatgtattcgggattccgggagcgaaaattgataaagtttttgatgtgatggaagaacgtggaccagaattaattgtcagtcgtcatgaacaaaatgcggcgtttatggctgctgctatcggtcgtctaaccgggaaacctggtgttgtacttgtaactagtggacctggcgcatcgaatcttgcaacagggcttgtaaccgcaactgcagaaggagatccagtcgttgcgattgctggtaacgtaacaaggcaagaccgcttaaaaagaacccaccaatcaatggataatgcagcacttttccgtccgattacaaaatacagcgaagaagtagttcacgccgaaagtattccagaagcaatcactaacgcttttcgctcggcaacagaaccaaaccaaggcgctgcttttgtcagtttgccacaagatatcgtgaacgaaccaaacgtaccagtaaaagcgattcgcccacttgctaaaccagaaaatggtcctgcttccaaagaacaagttgcaaaacttgttacacgtttgaaaaaagcgaaattaccggtattgctattgggtatgcgagcatctagtccagaagtaactggtgcaattcgtcgcttactccaaaaaacaagtatcccagtagtagaaactttccaagcagctggcgtcatttcacgcgacttagaagataacttctttggacgtgttggtctgttccgcaaccaaccaggggatattttgttaaataaagctgatttagttattacagtgggttatgatccaattgaatacgatccaaaagcttggaatgcctctggtgatagaacgattgtccatttagacgacattcgcgctgatattgatcattattaccaaccagtgacagagctagtcggaaacatcgcgcttactttagaccgagtgaatgcgaaattcagcggtttagaattagcggaaaaagaacttgaaacattaaaagaacttcatgctcaattagaagagcgagatgttccgccagaaagtgatgaaactaaccgagtacatccattgtcggtcattcaaacactacgttcggcaattgatgacaacgtaactgtgacagtcgacgttggttcacattatatttggatggcacgtcatttccgctcctatgaaccacgccgtctgcttttcagtaacggtatgcaaacgcttggtgttgcgcttccttggggaattgctgcaacacttgtacatccgggtgaaaaagtggtttcgatttctggtgacggtggtttcttattttccgcgatggaattagaaacagctgtccgcttgcgtgcgccacttgtacacctagtatggaatgacggaagctatgacatggttgctttccaacaaaaaatgaaatacggcaaagaagcagctgttcgttttggcgatgttgatatcgtaaaatttgcagaaagtttcggagcaaaaggtcttcgcgtaacaaatccagcagaactttctgatgtgttaaaagaagcgcttgaaacagaaggacccgtcgttgtagatattccaattgattaccgtgataacatcaaacttggcgaaactttactacctgaccaattttattaa

SEQ ID NO: 90 - protein, 565 aa, Listeria monocytogenes
MAKLEKDQEKVITQGKSGADLVVDSLINQGVTHVFGIPGAKIDKVFDVMEERGPELIVSRHEQNAAFMAAAIGRLTGKPGVVLVTSGPGASNLATGLVTATAEGDPVVAIAGNVTRQDRLKRTHQSMDNAALFRPITKYSEEVVHAESIPEAITNAFRSATEPNQGAAFVSLPQDIVNEPNVPVKAIRPLAKPENGPASKEQVAKLVTRLKKAKLPVLLLGMRASSPEVTGAIRRLLQKTSIPVVETFQAAGVISRDLEDNFFGRVGLFRNQPGDILLNKADLVITVGYDPIEYDPKAWNASGDRTIVHLDDIRADIDHYYQPVTELVGNIALTLDRVNAKFSGLELAEKELETLKELHAQLEERDVPPESDETNRVHPLSVIQTLRSAIDDNVTVTVDVGSHYIWMARHFRSYEPRRLLFSNGMQTLGVALPWGIAATLVHPGEKVVSISGDGGFLFSAMELETAVRLRAPLVHLVWNDGSYDMVAFQQKMKYGKEAAVRFGDVDIVKFAESFGAKGLRVTNPAELSDVLKEALETEGPVVVDIPIDYRDNIKLGETLLPDQFY

SEQ ID NO: 91 - DNA, 1680 bp, Streptococcus mutans
  CDS (1)..(1680)
atgaccgaaataaataaggaaggctatggggctgacctgattgtagacagcctcattaatcatgatgtcaactatgtttttggaatccctggtgcaaaaattgatcgtgtctttgataccttagaagataaggggccagaacttattgtagcacgccatgagcaaaatgctgcttttatggctcaaggaattggccgtattactggtgagcctggtgttgtgattacaaccagcggtcccggtgtttccaatctggtgactggtcttgttactgcgacagctgagggagatcctgtccttgctattggtggtcaggttaaacgtgctgatttgctcaaacgggctcaccagtcaatgaataatgttgctatgctcgatcccattaccaaatattcagcagaaattcaggatcccgcaacactttcagaaaatattgctaatgcctatcgtttggctaaagcaggaaagccgggagctagtttcttatctattcctcaagatataactgatagtcctgttactgtcaaggcgattaagcccttgacagatcctaaactaggttcagcgtcagttgctgatattaattatttggcacaggccataaaaaatgcggtccttcctgtcttacttttaggaaatggtgcgtcaacggctgcagttacagcttctattcgccgtttgttaggagctgtcaagctgccagtcgttgaaactttccaaggagctggtattgtttcaagagatttagaagaggacactttttttggtcgtgtggggctttttcgtaatcagcccggagatatgttgctgaagcgttctgacttagttatcgctattggctatgatcctattgaatatgaagcgcgcaattggaatgctgaaatttcggctcgcattatcgttattgatgttgctccagctgaaattgatacttatttccaacctgaacgtgaattaattggtgatatagctgaaacacttgatttactcctacctgctattagtggctactcacttccaaaaggttctcttgactatctcaaaggccttcgtgataatgtagtagaagatgtcaaatttgataagacagtcaaatccggtctggttcatccgcttgatgtgattgatgtccttcaaaagcaaacgactgatgatatgacagtaacggttgatgttggcagccattatatttggatggctcgttattttaaaagctatgaagcacggcacttacttttctcaaatggtatgcaaaccttaggtgttgctttgccttgggcaatttcggcagctcttgtacggccaaatgagaagattatttctatttcaggtgatggtggtttcctcttttctggccaagaattggaaacagctgttcgtttacatttaccaattgttcatatcatttggaatgatggtaaatataatatggttgaattccaagaagaaatgaaatacggccgttcagcaggtgttgattttggtcctgttgattttgtcaagtatgctgatagtttcggtgctaaaggttaccgtgctgatagtaaagaaaagtttgatcaagttcttcaaacagcactcaaggaagctgcaaatggcccagttctcattgatgttccaatggactataaagataatgtaaaattgggtgaaactattttgcctgatgaattctactaa

SEQ ID NO: 92 - protein, 559 aa, Streptococcus mutans
MTEINKEGYGADLIVDSLINHDVNYVFGIPGAKIDRVFDTLEDKGPELIVARHEQNAAFMAQGIGRITGEPGVVITTSGPGVSNLVTGLVTATAEGDPVLAIGGQVKRADLLKRAHQSMNNVAMLDPITKYSAEIQDPATLSENIANAYRLAKAGKPGASFLSIPQDITDSPVTVKAIKPLTDPKLGSASVADINYLAQAIKNAVLPVLLLGNGASTAAVTASIRRLLGAVKLPVVETFQGAGIVSRDLEEDTFFGRVGLFRNQPGDMLLKRSDLVIAIGYDPIEYEARNWNAEISARIIVIDVAPAEIDTYFQPERELIGDIAETLDLLLPAISGYSLPKGSLDYLKGLRDNVVEDVKFDKTVKSGLVHPLDVIDVLQKQTTDDMTVTVDVGSHYIWMARYFKSYEARHLLFSNGMQTLGVALPWAISAALVRPNEKIISISGDGGFLFSGQELETAVRLHLPIVHIIWNDGKYNMVEFQEEMKYGRSAGVDFGPVDFVKYADSFGAKGYRADSKEKFDQVLQTALKEAANGPVLIDVPMDYKDNVKLGETILPDEFY

SEQ ID NO: 93 - DNA, 1683 bp, Streptococcus thermophilus
  CDS (1)..(1683)
gtgttcatgtcagaagaaaagcaattgtatggtgcagatttagtggttgatagtttgatcaaccatgatgttgagtatgtctttgggattccaggcgcaaaaatcgatagggtttttgataccttggaagataagggacctgaattgattgttgcccgtcatgagcaaaatgctgcttttatggctcaaggtgttggacgtattactgggaaaccaggtgtagtattggtaacatctggtccaggtgtctccaatttggctactggtttggtaacagcgacggatgaaggagaccctgttcttgctattggtggtcaggttaagcgtgcagatctcttgaaacgtgcccaccaatcaatgaataacgttgctatgcttgagccaattaccaaatatgctgctgaagtacatgatgctaacaccctttctgaaacggttgctaatgcctatcgtcacgctaagtcagggaaaccaggtgcaagcttcatttcaattcctcaagacgtgacggatgctccggtcagtgttaaggctattaagcctatgacagatccaaaacttggttcagcatctgtttctgatattaactatctagcacaagccattaaaaatgcagtgttgccagtctttcttttggggaatggtgcctcatcagaagccgtaacttactctattcgccaaattttgaagcatgttaaattgccagttgttgaaactttccaaggtgccggtatcgtgtcacgtgaccttgaagaagatactttctttggtcgtgtaggtcttttccgtaaccaacccggagacatgttgcttaaaaaatccgacttagttattgccattggttatgatccaatcgaatatgaagcacgtaactggaatgctgaaatttcagcacgtatcatcgttattgatgtcgagccggccgaggtggacacttacttccaaccggaacgtgaattgattggtaatgtagaagcgagcttagacttgcttttgcccgctattcaaggttataaattgcctgaaggtgcggttgaatatcttaaaggtttgaaaaacaatgttgttgaggatgttaagtttgaccgtcagcctgatgaaggtacggtgcatccgctagatttcatcgaaaatttgcaagaacacacagatgatgatatgactgttacgtttgatgttggtagtcactatatttggatggcacgttatctcaaatcgtatgaaccacgtcatttgcttttctcaaatgggatgcaaacgataggtattgctattacatgggctatctctgcagcattggttcgtcctaagacaaaagtgatttctgtatctggtgatggtggtttcctcttctcagcacaagaattggaaacagcagttcgtttgaaattgccaattgtccatattatctggaacgatggtcattacaatatggtggaattccaggaagaaatgaagtacggtcgttcatctggggttgactttggtcctgtagattttgtaaaatatgctgagagctttggagccaaaggttatcgtgcaacaagtaaagcagcgtttgctagcttgcttcaagaggctttgactcaggctgtagatggaccagtccttattgatgttccaattgactataaagataacattaaactcggcgaaactattttgccagatgaattttactaa

SEQ ID NO: 94 - protein, 560 aa, Streptococcus thermophilus
VFMSEEKQLYGADLVVDSLINHDVEYVFGIPGAKIDRVFDTLEDKGPELIVARHEQNAAFMAQGVGRITGKPGVVLVTSGPGVSNLATGLVTATDEGDPVLAIGGQVKRADLLKRAHQSMNNVAMLEPITKYAAEVHDANTLSETVANAYRHAKSGKPGASFISIPQDVTDAPVSVKAIKPMTDPKLGSASVSDINYLAQAIKNAVLPVFLLGNGASSEAVTYSIRQILKHVKLPVVETFQGAGIVSRDLEEDTFFGRVGLFRNQPGDMLLKKSDLVIAIGYDPIEYEARNWNAEISARIIVIDVEPAEVDTYFQPERELIGNVEASLDLLLPAIQGYKLPEGAVEYLKGLKNNVVEDVKFDRQPDEGTVHPLDFIENLQEHTDDDMTVTFDVGSHYIWMARYLKSYEPRHLLFSNGMQTIGIAITWAISAALVRPKTKVISVSGDGGFLFSAQELETAVRLKLPIVHIIWNDGHYNMVEFQEEMKYGRSSGVDFGPVDFVKYAESFGAKGYRATSKAAFASLLQEALTQAVDGPVLIDVPIDYKDNIKLGETILPDEFY

SEQ ID NO: 95 - DNA, 1665 bp, Vibrio angustum
  CDS (1)..(1665)
atgtcggataaaaccgtctctggtgctgaactggttgttgaaactttaaatgcacataacgttccacacatttttggtattcctggagcaaaggtggatgctgttttcgatgctgtttgtgataacggaccagaaatcattatttgtcatcatgaacaaaatgcagcgtttatggcagcagcaactgggcgtttaacgggtaaagcaggcatttgtttagcaacctctggaccaggcgcatcaaaccttgtcacaggcgttgcaacagcgaatagtgaaggtgatcctgtggttgcacttgcaggtgctgtacctctttctatgtattctcacaatactcatcaatccatggatacccgttcactgtttactcctatcaccaagttttcagcagaagtgatggatagcagctcggtatctgatgttgtacataaagcttttcgtattgcagagcaacctacccaaggtgctagctttgttagtctaccgcaagatattctaactaaccgtattccttaccagccagtacaacagcctaatccaattttgttcggtggtgcacacccacaagctattcgtcaggctgctgatcgcattaatgctgcaaaaaatccggtgttattactgggcatggatgcaagccagccttttgttgctgatgctattcgccaactactcaaacaaacaccaattgccgttgtgaatacgtttgccgcagctggggttatttctcatgatttatacaactgctttttaggtcgtgttggcttatttaaaaatcaacccggtgatattgcattaaacagtgcagatttaatcattaccattggctacagcccaattgaatacgatccgattctttggaataaagatgcaaacacaccaattattcatattggttatcaacaagcagatttagaaattagctataaccctgtttgtgaagttgtgggtgacttagcggtgtctgtcacgtctattgcttctgaattagataagcgagaatcattagaaaataaccaacaaatccaattattacgccacgatttacaacatattatgcagatgggggtaaataaaacctcaacaaacggcgttcacccgcttcgttttgttcatgagttacgtcgctttgttagtgacgacaccactgtatgttgtgatgtaggctctatttatatttggatggcacgttacttccacagctttgaacctcgtcgtttattgttcagcaatggccaacaaacattgggcgtagctttaccttgggcaattgcagcttcccttcttcaccctaatgaaaaagtaatttccatgtctggtgatggtggcttcctattctcatcaatggaattagccacggccgttcgccataaatgtaatatcgttcactttgtttggacagatcacagttatgacatggttaagatccaacagcttaaaaagtatggtcgagagagtgccgtcagctttataggtcctgatattgttaagtacgcagaaagcttcggcgcacatggtttagcgatcaatactgccgatgatattgagcctgttatgcgaaaagctatgagcttaagtggcccagtattggtcaacgtcaatgttgattatagcgataacagtcgcctacttgatcaacttcatccatgccaacaagattaa

SEQ ID NO: 96 - protein, 554 aa, Vibrio angustum
MSDKTVSGAELVVETLNAHNVPHIFGIPGAKVDAVFDAVCDNGPEIIICHHEQNAAFMAAATGRLTGKAGICLATSGPGASNLVTGVATANSEGDPVVALAGAVPLSMYSHNTHQSMDTRSLFTPITKFSAEVMDSSSVSDVVHKAFRIAEQPTQGASFVSLPQDILTNRIPYQPVQQPNPILFGGAHPQAIRQAADRINAAKNPVLLLGMDASQPFVADAIRQLLKQTPIAVVNTFAAAGVISHDLYNCFLGRVGLFKNQPGDIALNSADLIITIGYSPIEYDPILWNKDANTPIIHIGYQQADLEISYNPVCEVVGDLAVSVTSIASELDKRESLENNQQIQLLRHDLQHIMQMGVNKTSTNGVHPLRFVHELRRFVSDDTTVCCDVGSIYIWMARYFHSFEPRRLLFSNGQQTLGVALPWAIAASLLHPNEKVISMSGDGGFLFSSMELATAVRHKCNIVHFVWTDHSYDMVKIQQLKKYGRESAVSFIGPDIVKYAESFGAHGLAINTADDIEPVMRKAMSLSGPVLVNVNVDYSDNSRLLDQLHPCQQD

SEQ ID NO: 97 - DNA, 1689 bp, Bacillus cereus
ttgagtacaggtgtaaaagcaaacgacgtgaagacaaaaacaaaaggagcagatcttgttgttgattgtttaattaaacaaggtgttacacatgttttcggtattccaggagcaaagattgactctgtatttgatgtactgcaagaaagaggaccagagttaattgtttgtcgtcatgaacaaaatgcagcatttatggcagctgctattggtagattaacaggaaaaccgggcgtatgtcttgtaacttcaggaccagggacatcaaatttagcgacaggtcttgttactgcgaatgcggagagtgatcccgttgttgctttagctggtgcagttccgcgtacggatcgattaaaacgtacacatcaatctatggataatgctgcactattcgaaccaatcacaaaatatagcgtagaagtagagcatcctgataatgtgccagaagcattatcaaatgcattccgaagtgcgacttctacaaatccaggagcaactttagtaagtttgccgcaagacgttatgactgcggaaacgactgtagagtctatcggtgcgctttctaagccacagcttggaatcgctcccacacatgatattacatatgtagtagataaaataaaagcagcgaaattaccagttattttactcggtatgagagcgagcacaaatgaagtgacgaaagccgttcgtaaattaattgcggatacagaacttcctgtcgttgaaacatatcaagcggctggtgccatttcacgtgagttagaagatcatttcttcggccgtgttggactattccgtaaccaaccaggtgatattttactagaagaggcagatcttgttatttctatcggttatgatccaattgagtatgatccaaagttctggaataaacttggagacagaacgattattcatcttgatgaccatcaagcagatatagatcatgattaccaaccagagcgtgaattaattggtgatattgccttaacagtaaatagcatcgcagaaaagttaccgaaacttgtgttaagtacgaaatcagaagcagtgttagaacgattacgcgcgaaattatcagaacaagcagaagttccaaatcgtccttcagaaggtgttacacatccgcttcaagtgattcgtacacttcgttctttaattagtgacgacacaaccgttacatgtgacatcggttcccattctatttggatggcgagatgtttccgttcttatgaaccacgtagattattatttagtaacggtatgcagacgttaggtgttgcacttccttgggcaattgctgctactttagtagaaccaggtaaaaaagtagtttccgtatcaggtgacggtggtttcttattctcagcgatggagttagaaacggcggtacgtttaaattctccaatcgtccatcttgtttggagagacggcacatatgatatggttgcattccaacaaatgatgaaatacggcagaacatcagctacagagtttggtgatgttgatcttgttaaatatgcggaaagtttcggggcgttaggtcttcgtgttaacacgcctgatgaattagaaggggtattgaaagaagcactagcagcagacggccctgtcattattgatattccaattgactatcgtgacaacattaaattaagcgaaaaattattaccaaaccaattaaactaa

SEQ ID NO: 98 - protein, 562 aa, Bacillus cereus
MSTGVKANDVKTKTKGADLVVDCLIKQGVTHVFGIPGAKIDSVFDVLQERGPELIVCRHEQNAAFMAAAIGRLTGKPGVCLVTSGPGTSNLATGLVTANAESDPVVALAGAVPRTDRLKRTHQSMDNAALFEPITKYSVEVEHPDNVPEALSNAFRSATSTNPGATLVSLPQDVMTAETTVESIGALSKPQLGIAPTHDITYVVDKIKAAKLPVILLGMRASTNEVTKAVRKLIADTELPVVETYQAAGAISRELEDHFFGRVGLFRNQPGDILLEEADLVISIGYDPIEYDPKFWNKLGDRTIIHLDDHQADIDHDYQPERELIGDIALTVNSIAEKLPKLVLSTKSEAVLERLRAKLSEQAEVPNRPSEGVTHPLQVIRTLRSLISDDTTVTCDIGSHSIWMARCFRSYEPRRLLFSNGMQTLGVALPWAIAATLVEPGKKVVSVSGDGGFLFSAMELETAVRLNSPIVHLVWRDGTYDMVAFQQMMKYGRTSATEFGDVDLVKYAESFGALGLRVNTPDELEGVLKEALAADGPVIIDIPIDYRDNIKLSEKLLPNQLN

SEQ ID NO: 99 - DNA, 780 bp, Klebsiella pneumoniae
atgaatcattctgctgaatgcacctgcgaagagagtctatgcgaaaccctgcgggcgttttccgcgcagcatcccgagagcgtgctctatcagacatcgctcatgagcgccctgctgagcggggtttacgaaggcagcaccaccatcgcggacctgctgaaacacggcgatttcggcctcggcacctttaatgagctggacggggagctgatcgccttcagcagtcaggtctatcagctgcgcgccgacggcagcgcgcgcaaagcccagccggagcagaaaacgccgttcgcggtgatgacctggttccagccgcagtaccggaaaacctttgaccatccggtgagccgccagcagctgcacgaggtgatcgaccagcaaatcccctctgacaacctgttctgcgccctgcgcatcgacggccatttccgccatgcccatacccgcaccgtgccgcgccagacgccgccgtaccgggcgatgaccgacgtcctcgacgatcagccggtgttccgctttaaccagcgcgaaggggtgctggtcggcttccggaccccgcagcatatgcaggggatcaacgtcgccgggtatcacgagcactttattaccgatgaccgcaaaggcggcggtcacctgctggattaccagctcgaccatggggtgctgaccttcggcgaaattcacaagctgatgatcgacctgcccgccgacagcgcgttcctgcaggctaatctgcatcccgataatctcgatgccgccatccgttccgtagaaagttaa

SEQ ID NO: 100 - protein, 259 aa, Klebsiella pneumoniae
MNHSAECTCEESLCETLRAFSAQHPESVLYQTSLMSALLSGVYEGSTTIADLLKHGDFGLGTFNELDGELIAFSSQVYQLRADGSARKAQPEQKTPFAVMTWFQPQYRKTFDHPVSRQQLHEVIDQQIPSDNLFCALRIDGHFRHAHTRTVPRQTPPYRAMTDVLDDQPVFRFNQREGVLVGFRTPQHMQGINVAGYHEHFITDDRKGGGHLLDYQLDHGVLTFGEIHKLMIDLPADSAFLQANLHPDNLDAAIRSVES

SEQ ID NO: 101 - DNA, 768 bp, Bacillus subtilis
atgaaacgagaaagcaacattcaagtgctcagccgtggtcaaaaagatcagcctgtgagccagatttatcaagtatcaacaatgacttctctattagacggagtatatgacggagattttgaactgtcagagattccgaaatatggagacttcggtatcggaacctttaacaagcttgacggagagctgattgggtttgacggcgaattttaccgtcttcgctcagacggaaccgcgacaccggtccaaaatggagaccgttcaccgttctgttcatttacgttctttacaccggacatgacgcacaaaattgatgcgaaaatgacacgcgaagactttgaaaaagagatcaacagcatgctgccaagcagaaacttattttatgcaattcgcattgacggattgtttaaaaaggtgcagacaagaacagtagaacttcaagaaaaaccttacgtgccaatggttgaagcggtcaaaacacagccgattttcaacttcgacaacgtgagaggaacgattgtaggtttcttgacaccagcttatgcaaacggaatcgccgtttctggctatcacctgcacttcattgacgaaggacgcaattcaggcggacacgtttttgactatgtgcttgaggattgcacggttacgatttctcaaaaaatgaacatgaatctcagacttccgaacacagcggatttctttaatgcgaatctggataaccctgattttgcgaaagatatcgaaacaactgaaggaagccctgaataa

SEQ ID NO: 102 - protein, 255 aa, Bacillus subtilis
MKRESNIQVLSRGQKDQPVSQIYQVSTMTSLLDGVYDGDFELSEIPKYGDFGIGTFNKLDGELIGFDGEFYRLRSDGTATPVQNGDRSPFCSFTFFTPDMTHKIDAKMTREDFEKEINSMLPSRNLFYAIRIDGLFKKVQTRTVELQEKPYVPMVEAVKTQPIFNFDNVRGTIVGFLTPAYANGIAVSGYHLHFIDEGRNSGGHVFDYVLEDCTVTISQKMNMNLRLPNTADFFNANLDNPDFAKDIETTEGSPE

SEQ ID NO: 103 - DNA, 780 bp, Klebsiella terrigena
gtgaatcattatcctgaatgcacctgccaggagagcctgtgcgaaaccgtacgcggcttctccgcccaccaccctgatagcgttatctatcagacctctctgatgagcgcgctgctgagcggggtctatgagggtagcaccaccatcgccgacctgctgacccacggcgacttcggtctcggcacctttaacgaactcgatggcgaactgattgcctttagcagcgaggtctaccagctgcgcgctgacggcagcgcgcgtaaagcccgggcggatcaaaaaacgcccttcgcggtgatgacctggttcagaccgcagtaccgtaaaacctttgaccacccggtcagccgccagcagctgcacgacgttatcgaccagcaaatcccctccgataacctgttctgcgccctgcatattgatggtcactttcgccacgcccacacccgcaccgtgccgcggcagacgccgccctatcgggcgatgaccgacgtgctcgatgaccagccggttttccgcttcaaccagcgcaaggggacgctggtcggctttcgcaccccgcagcatatgcagggccttaacgttgccggctaccacgagcactttattaccgacgatcgccagggcggcggccatctgctggactaccagctcgatagcggcgtgctgaccttcggcgagatccacaagctgatgattgacctcccggccgacagcgctttcctgcaggccgacctgcatcctgacaatctcgatgccgctattcgtgcggtagaaaactaa

SEQ ID NO: 104 - protein, 259 aa, Klebsiella terrigena
MNHYPECTCQESLCETVRGFSAHHPDSVIYQTSLMSALLSGVYEGSTTIADLLTHGDFGLGTFNELDGELIAFSSEVYQLRADGSARKARADQKTPFAVMTWFRPQYRKTFDHPVSRQQLHDVIDQQIPSDNLFCALHIDGHFRHAHTRTVPRQTPPYRAMTDVLDDQPVFRFNQRKGTLVGFRTPQHMQGLNVAGYHEHFITDDRQGGGHLLDYQLDSGVLTFGEIHKLMIDLPADSAFLQADLHPDNLDAAIRAVEN

SEQ ID NO: 105 - DNA, 771 bp, Klebsiella pneumoniae
atgaaaaaagtcgcacttgttaccggcgccggccaggggattggtaaagctatcgcccttcgtctggtgaaggatggatttgccgtggccattgccgattataacgacgccaccgccaaagcggtcgcctcggaaatcaaccaggccggcggacacgccgtggcggtgaaagtggatgtctccgaccgcgatcaggtatttgccgccgttgaacaggcgcgcaaaacgctgggcggcttcgacgtcatcgtcaataacgccggtgtggcaccgtctacgccgatcgagtccattaccccggagattgtcgacaaagtctacaacatcaacgtcaaaggggtgatctggggtattcaggcggcggtcgaggcctttaagaaagaggggcacggcgggaaaatcatcaacgcctgttcccaggccggccacgtcggcaacccggagctggcggtgtatagctccagtaaattcgcggtacgcggcttaacccagaccgccgctcgcgacctcgcgccgctgggcatcacggtcaacggctactgcccggggattgtcaaaacgccaatgtgggccgaaattgaccgccaggtgtccgaagccgccggtaaaccgctgggctacggtaccgccgagttcgccaaacgcatcactctcggtcgtctgtccgagccggaagatgtcgccgcctgcgtctcctatcttgccagcccggattctgattacatgaccggtcagtcgttgctgatcgacggcgggatggtatttaactaa

SEQ ID NO: 106 - protein, 256 aa, Klebsiella pneumoniae
MKKVALVTGAGQGIGKAIALRLVKDGFAVAIADYNDATAKAVASEINQAGGHAVAVKVDVSDRDQVFAAVEQARKTLGGFDVIVNNAGVAPSTPIESITPEIVDKVYNINVKGVIWGIQAAVEAFKKEGHGGKIINACSQAGHVGNPELAVYSSSKFAVRGLTQTAARDLAPLGITVNGYCPGIVKTPMWAEIDRQVSEAAGKPLGYGTAEFAKRITLGRLSEPEDVAACVSYLASPDSDYMTGQSLLIDGGMVFN

SEQ ID NO: 107 - DNA, 1053 bp, Bacillus cereus
atgaaagcactactttggcataatcaacgtgatgtacgagtagaagaagtaccagaaccaacagtaaaaccaggaacagtgaaaatcaaagttaaatggtgtggtatttgtgggacagacttgcatgaatatttagcagggcctatttttattccaacagaagaacatccattaacacatgtgaaagcacctgttattttaggtcatgagtttagtggtgaggtaatagagattggtgaaggagttacatctcataaagtgggagaccgcgttgttgtagagccaatttattcttgtggtaaatgtgaagcttgtaaacatggacattacaatgtttgtgaacaacttgttttccacggtcttggcggagaaggcggcggtttctctgaatatacagtagtaccagaagatatggttcatcacattccagatgaaatgacgtatgaacaaggtgcgcttgtagaaccagcagcagtagcagttcatgcagtacgtcaaagtaaattaaaagaaggggaagctgtagcggtatttggttgcggtccaattggacttcttgttatccaagcagctaaagcagcaggagcaactcctgttattgcagttgaactttctaaagaacgtcaagagttagcgaaattagcaggtgcggattatgtattaaatccagcaactcaagatgtgttagctgaaattcgtaacttaacaaatggtttaggtgtaaatgttagctttgaagtaacaggtgttgaagttgtactacgccaagcgattgaaagtacaagcttcgaaggacaaactgtaattgttagtgtatgggaaaaagacgcaacaattactccaaataacttagtattaaaagaaaaagaagttattggtattttaggataccgtcacatcttcccagctgttattaaattgattagctccggtcaaattcaagcagagaaattaattacgaaaaaaattacagtggatcaagttgttgaagaaggatttgaagcacttgtaaaagataaaacacaagtgaaaattcttgtttcacctaaataa

SEQ ID NO: 108 - protein, 350 aa, Bacillus cereus
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 109 - DNA, 1113 bp, Lactococcus lactis
ttgcctgaaacgacaaccatcctatatagaggaggcgtttttatgcgcgcagcacgtttttacgaccgcggggatatccgcattgatgaaattaatgaaccaatagtaaaagctggccaagttggcattgatgtggcttggtgtggaatttgtggaacagatctccatgaatttttagatggcccaattttttgtccgtcagcagaacatcctaatccaattactggagaagtaccaccagtcactcttggacatgaaatgtctggggttgtaaattttataggtgaaggagtaagcggacttaaagtaggtgaccatgtcgttgtcgaaccttatatcgttcccgaagggactgatacaagtgaaactggacattataacctctcagaaggctcaaactttattggtttgggcggaaatggtggaggtttggctgaaaaaatttctgttgatgaacgttgggttcacaaaattcctgataacttaccattggatgaagctgctctaattgagccactatcagtcggctatcacgctgttgaacgagcaaatttaagtgaaaagagtacggtattagttgttggtgctggaccaattggactattaactgctgccgttgcaaaagcgcaaggacatactgttatcatcagtgaacctagtggacttcgtcgtaaaaaagcacaagaagcacaagttgctgattatttcttcaatccaattgaagatgacattcaagctaaagttcatgaaattaatgaaaaaggagtggacgcagcctttgaatgtacctctgtccaaccgggatttgacgcttgtctagatgcgattcgtatgggtggaacagttgtcattgtcgcaatttggggcaagcctgctagtgttgatatggcaaaattagtaatcaaagaagctaaccttttaggaacgattgcttataataacactcatccaaaaacaattgatttagtatcaacaggtaaaataaaattggaccaattcatcacagctaaaatcggtttggatgatttgattgataaaggattcgatacgctgattcatcataatgaaacagctgttaaaattttagtttcaccaactggtaaaggtctataa

SEQ ID NO: 110 - protein, 370 aa, Lactococcus lactis
MPETTTILYRGGVFMRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 111 - DNA, 2532 bp, Roseburia inulinivorans
atgggcaattacgattcaacaccgatagctaaaagtgataggattaaaagattggttgatcatttgtatgctaaaatgcctgaaattgaggccgctagagcagagctaattactgaatcctttaaggccaccgaaggtcaacctgttgttatgagaaaggctagagcttttgaacatatactaaagaatttgccaattatcataagaccagaagaactgattgttggctcaactacaattgcccctagaggttgccaaacgtatccagaattctcatacgagtggttagaggctgaatttgaaactgtcgaaacgcgttcagctgacccattttatatttcagaagaaacgaagaaacgtttgctggctgccgatgcttattggaaaggtaaaacaacctcagagttggcaacttcatatatggccccagaaactctaagagccatgaagcataacttcttcacccctggaaactacttctacaatggtgtcggtcatgtcacagttcaatatgaaacagtattagcaatcggcttgaatggagtaaaagagaaggttaggaaagagatggagaattgtcattttggtgatgccgattatagtacaaagatgtgtttcttggagagcattttaatatcgtgtgatgccgtaatcacttatgctaatagatatgccaagatggccgaggaaatggctgaaaaagaaacagatgctgcaaggaggcaagaactattaacaatcgccagggtttgcaaaaacgttcctgaattcccagccgaaagcttccaggaggcctgccaatccttttggttcatacaacaagtgcttcaaattgaatccagtggtcattcaatttccccaggtagatttgatcaatatatgtatccttattacgaaaaggatttaaaggaaggtagcttaactagggaatatgctcaggaactgatcgattgtatctgggttaagttaaatgatctgaataagtgcagggatgctgcctctgctgagggctttgcaggatattccttatttcaaaacttaatcgttgggggccaaacggttcaaggaagggacgccaccaatgatttgagttttatgtgtatcacggcatctgaacacgtctttttaccgatgccgtcgttgtctataagagtttggcatggtagttccaaagcactgcttatgagagcagctgaattgactagaaccggtataggcttacctgcttattacaatgatgaagtcatcataccagctttggtgcataggggtgctactatggatgaagcaagaaattacaacataataggatgtgtcgaaccgcaggttcctggtaaaactgatggctggcacgatgcagcattctttaacatgtgcagacctttggaaatggtgtttagtaatggttatgataacggtgaaattgcatctatacaaactggtaacgtagaatcttttcagagttttgatgagtttatggaagcttacagaaaacaaatgctatataacatagaacttatggtaaatgccgacaacgcgatagattatgcccacgcaaagttggccccattgccatttgagtcatgtttggttgatgactgtataaagagaggaatgtccgctcaggaaggcggcgcaatctataatttcactggtccacagggctttggtattgcaaacgttgctgatagcttgtatacgattaagaaattggtgttcgaggagaagagaattacgatgggtgaattaaagaaagcgttggaaatgaattatggtaagggtttggatgccacaaccgctggtgacatcgcaatgcaggtcgcgaagggactaaaagatgccggacaggaagtgggtcccgacgtgatcgctaatacaatccgtcaagttcttgaaatggaattaccagaagatgtaagaaagagatatgaagagatccatgaaatgatacttgagttaccaaagtatggtaatgatatagatgaagttgatgaattagctagagaagcagcttacttttacacaagaccattagaaacttttaagaatccaaggggtggcatgtatcaagccggcctttatcccgtgtccgctaatgtgccactaggcgctcaaacgggggccacacccgatggacgtttggcgcatacacccgtggcggatggcgttggtccgacatcaggcttcgatatatccggaccaacagcttcttgcaattctgtcgccaagttggatcatgctatagcctctaatggtaccttatttaatatgaagatgcacccaaccgcaatggcaggtgaaaagggcttagaatccttcatatcgttgatccgtggttatttcgatcaacaaggtatgcacatgcaatttaacgtagtagacagggctacactgcttgatgcgcaggcccaccctgaaaagtattcaggcttaattgtcagagtggcaggttattctgccctttttaccacattgtccaagtcattacaagatgatataatcaaacgtaccgaacaagcagacaatagatag

SEQ ID NO: 112 - protein, 843 aa, Roseburia inulinivorans
MGNYDSTPIAKSDRIKRLVDHLYAKMPEIEAARAELITESFKATEGQPVVMRKARAFEHILKNLPIIIRPEELIVGSTTIAPRGCQTYPEFSYEWLEAEFETVETRSADPFYISEETKKRLLAADAYWKGKTTSELATSYMAPETLRAMKHNFFTPGNYFYNGVGHVTVQYETVLAIGLNGVKEKVRKEMENCHFGDADYSTKMCFLESILISCDAVITYANRYAKMAEEMAEKETDAARRQELLTIARVCKNVPEFPAESFQEACQSFWFIQQVLQIESSGHSISPGRFDQYMYPYYEKDLKEGSLTREYAQELIDCIWVKLNDLNKCRDAASAEGFAGYSLFQNLIVGGQTVQGRDATNDLSFMCITASEHVFLPMPSLSIRVWHGSSKALLMRAAELTRTGIGLPAYYNDEVIIPALVHRGATMDEARNYNIIGCVEPQVPGKTDGWHDAAFFNMCRPLEMVFSNGYDNGEIASIQTGNVESFQSFDEFMEAYRKQMLYNIELMVNADNAIDYAHAKLAPLPFESCLVDDCIKRGMSAQEGGAIYNFTGPQGFGIANVADSLYTIKKLVFEEKRITMGELKKALEMNYGKGLDATTAGDIAMQVAKGLKDAGQEVGPDVIANTIRQVLEMELPEDVRKRYEEIHEMILELPKYGNDIDEVDELAREAAYFYTRPLETFKNPRGGMYQAGLYPVSANVPLGAQTGATPDGRLAHTPVADGVGPTSGFDISGPTASCNSVAKLDHAIASNGTLFNMKMHPTAMAGEKGLESFISLIRGYFDQQGMHMQFNVVDRATLLDAQAHPEKYSGLIVRVAGYSALFTTLSKSLQDDIIKRTEQADNR

SEQ ID NO: 113 - DNA, 794 bp, Roseburia inulinivorans
atgaaagaatatcttaatacttcaggtagaatatttgatatccagaggtattctattcacgatggccctggtgtgcgtacaattgtgtttctaaaaggttgtgcccttagatgcagatggtgctgtaatcctgaaagccaaagcttcgaagttgaaacaatgacgattaatggaaaacctaaagtcatgggtaaagatgttacagtcgccgaggttatgaagacggtagaaagagacatgccttattaccttcaatcaggtggtggtatcaccttatcgggtggcgaatgtactttgcaaccagaattttcccttggcctattgagagctgcaaaggatttgggcatatccacggcaatagagagcatggcgtacgcaaagtacgaagtaatagaaactcttcttccgtatttggatacgtatttaatggacatcaaacatatgaatcctgagaaacataaagaatacactggtcatgataacttgaggatgttagaaaacgccttaagagtcgcgcattctggtcagaccgaactgatcatcagagtacctgtcatcccaggattcaacgcaactgagcaggaactactagatattgcaaaattcgcagatacactgcctggagttagacaaatacacatcttgccatatcataattttggtcagggtaaatacgaaggattgaacagggactatccgatgggggacactgagaaaccctctaatgaacagatgaaagcttttcaagaaatgattcaaaagaacacttccctacattgccaaatcggtggtta

SEQ ID NO: 114 - protein, 264 aa, roseburia inulinivorans
MKEYLNTSGRIFDIQRYSIHDGPGVRTIVFLKGCALRCRWCCNPESQSFEVETMTINGKPKVMGKDVTVAEVMKTVERDMPYYLQSGGGITLSGGECTLQPEFSLGLLRAAKDLGISTAIESMAYAKYEVIETLLPYLDTYLMDIKHMNPEKHKEYTGHDNLRMLENALRVAHSGQTELIIRVPVIPGFNATEQELLDIAKFADTLPGVRQIHILPYHNFGQGKYEGLNRDYPMGDTEKPSNEQMKAFQEMIQKNTSLHCQIGG

SEQ ID NO: 115 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 116 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 117 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 118 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 119 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 120 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 121 - DNA, 1014 bp, Pseudomonas aeruginosa
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 122 - protein, 338 aa, Pseudomonas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 123 - DNA, 1014 bp, Pseudomonas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 124 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 125 - DNA, 1014 bp, artificial sequence
  Mutant of Pseudomonas fluorescens ilvC coding region
atgaaggtgttttacgataaagactgcgatctgagcatcatccagggaaagaaggttgctattataggatatggttcccaaggacacgcacaagccttgaacttgaaagattctggggtcgacgtgacagtaggtctgtataaaggtgctgctgatgcagcaaaggctgaagcacatggctttaaagtcacagatgttgcagcggctgttgctggcgctgatttagtcatgattttaattccagatgaatttcaatcgcaattgtacaaaaatgaaatagaaccaaacattaagaagggcgctaccttggccttcagtcatggatttgccattcattacaatcaagtagtccccagggcagatttggacgttattatgattgcacctaaggctccggggcatactgttaggagcgaatttgttaagggtggtggtattccagatttgatcgctatataccaagacgttagcggaaacgctaagaatgtagctttaagctacgcagcaggagttggtggcgggagaacgggtataatagaaaccacttttaaagacgagactgagacagatttatttggagaacaagcggttctgtgcggaggaactgttgaattggttaaagcaggctttgagacgcttgtcgaagcagggtacgctcccgaaatggcatacttcgaatgtctacatgaattgaagttgatagtagacttaatgtatgaaggtggtatagctaatatgaactattccatttcaaataatgcagaatatggtgagtatgtcaccggacctgaagtcattaacgcagaatcaagacaagccatgagaaatgccttgaaacgtatccaggacggtgaatacgctaagatgttcataagtgaaggcgctacgggttacccgagtatgactgctaaaagaagaaacaatgcagcacatggtatcgaaattattggtgaacagttaaggtctatgatgccctggatcggtgctaataagatcgtagacaaggcgaaaaat

SEQ ID NO: 126 - protein, 338 aa, artificial sequence
  mutant of Pseudomonas fluorescens protein
MKVFYDKDCDLSIIQGKKVAIIGYGSQGHAQALNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAAVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 127 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 128 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 129 - DNA, 1713 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaa

SEQ ID NO: 130 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 131 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 132 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 133 - DNA, 1644 bp, artificial sequence
  codon optimized L. lactis kivD coding region for S. cerevisiae expression
atgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagc

SEQ ID NO: 134 - DNA, 1146 bp, Saccharomyces cerevisiae
atgagagctttggcatatttcaagaagggtgatattcacttcactaatgatatccctaggccagaaatccaaaccgacgatgaggttattatcgacgtctcttggtgtgggatttgtggctcggatcttcacgagtacttggatggtccaatcttcatgcctaaagatggagagtgccataaattatccaacgctgctttacctctggcaatgggccatgagatgtcaggaattgtttccaaggttggtcctaaagtgacaaaggtgaaggttggcgaccacgtggtcgttgatgctgccagcagttgtgcggacctgcattgctggccacactccaaattttacaattccaaaccatgtgatgcttgtcagaggggcagtgaaaatctatgtacccacgccggttttgtaggactaggtgtgatcagtggtggctttgctgaacaagtcgtagtctctcaacatcacattatcccggttccaaaggaaattcctctagatgtggctgctttagttgagcctctttctgtcacctggcatgctgttaagatttctggtttcaaaaaaggcagttcagccttggttcttggtgcaggtcccattgggttgtgtaccattttggtacttaagggaatgggggctagtaaaattgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaag

SEQ ID NO: 135 - protein, 382 aa, Saccharomyces cerevisiae
MRALAYFKKGDIHFTNDIPRPEIQTDDEVIIDVSWCGICGSDLHEYLDGPIFMPKDGECHKLSNAALPLAMGHEMSGIVSKVGPKVTKVKVGDHVVVDAASSCADLHCWPHSKFYNSKPCDACQRGSENLCTHAGFVGLGVISGGFAEQVVVSQHHIIPVPKEIPLDVAALVEPLSVTWHAVKISGFKKGSSALVLGAGPIGLCTILVLKGMGASKIVVSEIAERRIEMAKKLGVEVFNPSKHGHKSIEILRGLTKSHDGFDYSYDCSGIQVTFETSLKALTFKGTATNIAVWGPKPVPFQPMDVTLQEKVMTGSIGYVVEAFEEVVRAIHNGDIAMEDCKQLITGKQRIEDGWEKGFQELMDHKESNVKILLTPNNHGEMK

SEQ ID NO: 136 - DNA, 1125 bp, artificial sequence
  horse ADH coding region codon optimized for S. cerevisiae expression
atgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttt

SEQ ID NO: 137 - protein, 375 aa, Equus caballus
MSTAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 138 - DNA, 16387 bp, artificial sequence
  plasmid construct
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaagcatctaaaacacaaccgttggaagcgttggaaaccaacttagcatacttggatagagtacctcttgtgtaacgaggtggaggtgcaacccaactttgtttacgttgagccatttccttatcagagactaataggtcaatcttgttattatcagcatcaatgataatctcatcgccgtctctgaccaacccgataggaccaccttcagcggcttcgggaacaatgtggccgattaagaacccgtgagaaccaccagagaatctaccatcagtcaacaatgcaacatctttacccaaaccgtaacccatcagagcagaggaaggctttagcatttcaggcatacctggtgcacctcttggaccttcatatctgataacaacaacggttttttcacccttcttgatttcacctctttccaaggcttcaataaaggcaccttcctcttcgaacacacgtgctctacccttgaagtaagtaccttccttaccggtaattttacccacagctccacctggtgccaatgaaccgtacagaatttgcaagtgaccgttggccttgattgggtgggagagtggcttaataatctcttgtccttcaggtaggcttggtgctttctttgcacgttctgccaaagtgtcaccggtaacagtcattgtgttaccgtgcaacatgttgttttcatatagatacttaatcacagattgggtaccaccaacgttaatcaaatcggccatgacgtatttaccagaaggtttgaagtcaccgatcaatggtgtagtatcactgattctttggaaatcatctggtgacaacttgacacccgcagagtgagcaacagccaccaaatgcaaaacagcattagtggacccaccggttgcaacgacataagtaatggcgttttcaaaagcctcttttgtgaggatatcacgaggtaaaatacccaattccattgtcttcttgatgtattcaccaatgttgtcacactcagctaacttctccttggaaacggctgggaaggaagaggagtttggaatggtcaaacctagcacttcagcggcagaagccattgtgttggcagtatacataccaccacaagaaccaggacctgggcatgcatgttccacaacatcttctctttcttcttcagtgaattgcttggaaatatattcaccgtaggattggaacgcagagacgatatcgatgtttttagagatcctgttaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactagtatgaaggtgttttacgataaagactgcgatctgagcatcatccagggaaagaaggttgctattataggatatggttcccaaggacacgcacaagccttgaacttgaaagattctggggtcgacgtgacagtaggtctgtataaaggtgctgctgatgcagcaaaggctgaagcacatggctttaaagtcacagatgttgcagcggctgttgctggcgctgatttagtcatgattttaattccagatgaatttcaatcgcaattgtacaaaaatgaaatagaaccaaacattaagaagggcgctaccttggccttcagtcatggatttgccattcattacaatcaagtagtccccagggcagatttggacgttattatgattgcacctaaggctccggggcatactgttaggagcgaatttgttaagggtggtggtattccagatttgatcgctatataccaagacgttagcggaaacgctaagaatgtagctttaagctacgcagcaggagttggtggcgggagaacgggtataatagaaaccacttttaaagacgagactgagacagatttatttggagaacaagcggttctgtgcggaggaactgttgaattggttaaagcaggctttgagacgcttgtcgaagcagggtacgctcccgaaatggcatacttcgaatgtctacatgaattgaagttgatagtagacttaatgtatgaaggtggtatagctaatatgaactattccatttcaaataatgcagaatatggtgagtatgtcaccggacctgaagtcattaacgcagaatcaagacaagccatgagaaatgccttgaaacgtatccaggacggtgaatacgctaagatgttcataagtgaaggcgctacgggttacccgagtatgactgctaaaagaagaaacaatgcagcacatggtatcgaaattattggtgaacagttaaggtctatgatgccctggatcggtgctaataagatcgtagacaaggcgaaaaattaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagtatataatttttcaggtaaaatttagtacgatagtaaaatacttctcgaactcgtcacatatacgtgtacataatgtctgaaccagctcaaaagaaacaaaaggttgctaacaactctctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattattggttttctggtctcaactttctgacttccttaccaaccttccagatttccatgtttctgatggtgtctaattccttttctagcttttctctgtagtcaggttgagagttgaattccaaagatctcttggtttcggtaccgttcttggtagattcgtacaagtcttggaaaacaggcttcaaagcattcttgaagattgggtaccagtccaaagcacctcttctggcggtggtggaacaagcatcgtacatgtaatccataccgtacttaccgatcaatgggtatagagattgggtagcttcttcgacggtttcgttgaaagcttcagatggggagtgaccgttttctctcaagacgtcgtattgagccaagaacataccgtggataccacccattaaacaacctctttcaccgtacaagtcagagttgacttctctttcgaaagtggtttggtaaacgtaaccggaaccaatggcaacggccaaagcttgggccttttcgtgagccttaccggtgacatcgttccagacggcgtaagaagagttaataccacgaccttccttgaacaaagatctgacagttctaccggaaccctttggagcaaccaagataacatctaagtcctttggtggttcaacgtgagtcaagtccttgaagactggggagaaaccgtgggagaagtacaaagtcttacccttggtcaacaatggcttgatagcaggccaggtttctgattgagcggcatcggacaacaagttcataacgtaactacctctcttgatagcatcttcaacagtgaacaagttcttgcctggaacccaaccgtcttcgatggcagccttccaagaagcaccatctttacggacaccaatgataacgttcaaaccgttgtctctcaagttcaaaccttgaccgtaaccttgggaaccgtaaccgatcaaagcaaaagtgtcgttcttgaagtagtccaacaacttttctcttggccagtcagctctttcgtagacggtttcaacagtaccaccgaagttgatttgcttcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatctatccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 139 - DNA, 448 bp, Saccharomyces cerevisiae
cccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatc

SEQ ID NO: 140 - DNA, 250 bp, Saccharomyces cerevisiae
ccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatga

SEQ ID NO: 141 - DNA, 1181 bp, Saccharomyces cerevisiae
taaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactagt

SEQ ID NO: 142 - DNA, 759 bp, Saccharomyces cerevisiae
ggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagtatataatttttcaggtaaaatttagtacgatagtaaaatacttctcgaactcgtcacatatacgtgtacataatgtctgaaccagctcaaaagaaacaaaaggttgctaacaactctctaga

SEQ ID NO: 143 - DNA, 643 bp, Saccharomyces cerevisiae
gaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctaga

SEQ ID NO: 144 - DNA, 15539 bp, artificial sequence
  constructed plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 145 - DNA, 9089 bp, artificial sequence
  constructed plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggccctaacctgctaggacacaacgtctttgcctggtaaagtttctagctgacgtgattccttcacctgtggatccggcaattgtaaaggttgtgaaaccctcagcttcataaccgacacctgcaaatgactttgcattcttaacaaagatagttgtatcaatttcacgttcgaatctattaaggttatcgatgttcttagaataaatgtaggcggaatgttttctattctgctcagctatcttggcgtatttaatggcttcatcaatgtccttcactctaactataggcaaaattggcatcatcaactccgtcataacgaacggatggtttgcgttgacttcacaaataatacactttacattacttggtgactctacatctatttcatccaaaaacagtttagcgtccttaccaacccacttcttattaatgaaatattcttgagtttcattgttcttttgaagaacaaggtctatcagcttggatacttggtcttcattgataatgacggcgttgtttttcaacatgttagagatcagatcatctgcaacgttttcaaacacgaacacttctttttccgcgatacaaggaagattgttgtcaaacgaacaaccttcaataatgcttctgccggccttctcgatatctgctgtatcgtctacaataaccggaggattacccgcgccagctccgatggcctttttaccagaattaagaagggtttttaccatacccgggccacccgtaccgcacaacaattttatggatggatgtttgataatagcgtctaaactttccatagttgggttctttatagtagtgacaaggttttcaggtccaccacagctaattatggctttgtttatcatttctactgcgaaagcgacacactttttggcgcatgggtgaccattaaatacaactgcattccccgcagctatcatacctatagaattgcagataacggtttctgttggattcgtgcttggagttatagcgccgataactccgtatggactcatttcaaccactgttagtccattatcgccggaccatgctgttgttgtcagatcttcagtgcctggggtatacttggccactaattcatgtttcaagattttatcctcataccttcccatgtgggtttcctccaggatcattgtggctaagacctctttattctgtaatgcggcttttcttatttcggtgattattttctctctttgttcctttgtgtagtgtagggaaagaatcttttgtgcatgtactgcagaagaaatggcattctcaacattttcaaatactccaaaacatgaagagttatctttgtaattctttaagttgatgttttcaccattagtcttcactttcaagtctttggtggttgggattaaggtatctttatccatggtgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 146 - DNA, 1023 bp, Saccharomyces cerevisiae
caccgcggtggggcgcgccctattttcgaggaccttgtcaccttgagcccaagagagccaagatttaaattttcctatgacttgatgcaaattcccaaagctaataacatgcaagacacgtacggtcaagaagacatatttgacctcttaacaggttcagacgcgactgcctcatcagtaagacccgttgaaaagaacttacctgaaaaaaacgaatatatactagcgttgaatgttagcgtcaacaacaagaagtttaatgacgcggaggccaaggcaaaaagattccttgattacgtaagggagttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaactagtaaacaaa

SEQ ID NO: 147 - DNA, 21 bp, artificial sequence
  primer
caaaagctgagctccaccgcg

SEQ ID NO: 148 - DNA, 44 bp, artificial sequence
  primer
gtttactagtttatgtgtgtttattcgaaactaagttcttggtg

SEQ ID NO: 149 - DNA, 8994 bp, artificial sequence
  constructed plasmid
ctagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggta

SEQ ID NO: 150 - DNA, 753 bp, Saccharomyces cerevisiae
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 151 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 152 - DNA, 39 bp, artificial sequence
  primer
cacacatattacaatagctagctgaggatgaaagctctg

SEQ ID NO: 153 - DNA, 39 bp, artificial sequence
  primer
cagagctttcatcctcagctagctattgtaatatgtgtg

SEQ ID NO: 154 - DNA, 9491 bp, artificial sequence
  constructed plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 155 - DNA, 1000 bp, Saccharymoces cerevisiae
gttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 156 - DNA, 2145 bp, artificial sequence
  constructed chimeric gene
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 157 - DNA, 4280 bp, artificial sequence
  vector
ggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccccggctctgagacagtagtaggttagtcatcgctctaccgacgcgcaggaaaagaaagaagcattgcggattacgtattctaatgttcagcccgcggaacgccagcaaatcaccacccatgcgcatgatactgagtcttgtacacgctgggcttccagtgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcttcagcccgcggaacgccagcaaatcaccacccatgcgcatgatactgagtcttgtacacgctgggcttccagtgatgatacaacgagttagccaaggtgagcacggatgtctaaattagaattacgttttaatatctttttttccatatctagggctag

SEQ ID NO: 158 - DNA, 30 bp, artificial sequence
  primer
gcatgcttgcatttagtcgtgcaatgtatg

SEQ ID NO: 159 - DNA, 54 bp, artificial sequence
  primer
gaacattagaatacgtaatccgcaatgcactagtaccacaggtgttgtcctctg

SEQ ID NO: 160 - DNA, 54 bp, artificial sequence
  primer
cagaggacaacacctgtggtactagtgcattgcggattacgtattctaatgttc

SEQ ID NO: 161 - DNA, 28 bp, artificial sequence
  primer
caccttggctaactcgttgtatcatcac

SEQ ID NO: 162 - DNA, 100 bp, artificial sequence
  primer
ttttaagccgaatgagtgacagaaaaagcccacaacttatcaagtgatattgaacaaagggcgaaacttcgcatgcttgcatttagtcgtgcaatgtatg

SEQ ID NO: 163 - DNA, 98 bp, artificial sequence
  primer
cccaattggtaaatattcaacaagagacgcgcagtacgtaacatgcgaattgcgtaattcacggcgataacaccttggctaactcgttgtatcatcac

SEQ ID NO: 164 - DNA, 29 bp, artificial sequence
  primer
caaaagcccatgtcccacaccaaaggatg

SEQ ID NO: 165 - DNA, 26 bp, artificial sequence
  primer
caccatcgcgcgtgcatcactgcatg

SEQ ID NO: 166 - DNA, 28 bp, artificial sequence
  primer
tcggtttttgcaatatgacctgtgggcc

SEQ ID NO: 167 - DNA, 22 bp, artificial sequence
  primer
gagaagatgcggccagcaaaac

SEQ ID NO: 168 - DNA, 2745 bp, artificial sequence
  constructed coding region-terminator segment
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 169 - DNA, 99 bp, artificial sequence
  primer
tcctttctcaattattattttctactcataacctcacgcaaaataacacagtcaaatcaatcaaagtatgactgacaaaaaaactcttaaagacttaag

SEQ ID NO: 170 - DNA, 77 bp, artificial sequence
  primer
gaacattagaatacgtaatccgcaatgcttctttcttttccgtttaacgtatagacttctaatatatttctccatac

SEQ ID NO: 171 - DNA, 45 bp, artificial sequence
  primer
aaacggaaaagaaagaagcattgcggattacgtattctaatgttc

SEQ ID NO: 172 - DNA, 88 bp, artificial sequence
  primer
tatttttcgttacataaaaatgcttataaaactttaactaataattagagattaaatcgccaccttggctaactcgttgtatcatcac

SEQ ID NO: 173 - DNA, 27 bp, artificial sequence
  primer
gacttttggaagcctgaagaaactggc

SEQ ID NO: 174 - DNA, 20 bp, artificial sequence
  primer
cttggcagcaacaggactag

SEQ ID NO: 175 - DNA, 26 bp, artificial sequence
  primer
ccaggccaattcaacagactgtcggc

SEQ ID NO: 176 - DNA, 2347 bp, artificial sequence
  constructed URA3 marker with flanking homologous repeat sequences for HIS gene replacement and marker excision
gcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtg

SEQ ID NO: 177 - DNA, 80 bp, artificial sequence
  primer
cttcgaagaatatactaaaaaatgagcaggcaagataaacgaaggcaaaggcattgcggattacgtattctaatgttcag

SEQ ID NO: 178 - DNA, 80 bp, artificial sequence; identical to SEQ ID NO: 177
  primer

SEQ ID NO: 179 - DNA, 26 bp, artificial sequence
  primer
gacttgaataatgcagcggcgcttgc

SEQ ID NO: 180 - DNA, 30 bp, artificial sequence
  primer
ccaccctcttcaattagctaagatcatagc

SEQ ID NO: 181 - DNA, 25 bp, artificial sequence
  primer
aaaaattgattctcatcgtaaatgc

SEQ ID NO: 182 - DNA, 20 bp, artificial sequence
  primer
ctgcagcgaggagccgtaat

SEQ ID NO: 183 - DNA, 90 bp, artificial sequence
  primer
atggttcatttaggtccaaaaaaaccacaagccagaaagggttccatggccgatgtgccagcattgcggattacgtattctaatgttcag

SEQ ID NO: 184 - DNA, 91 bp, artificial sequence
  primer
ttaagcaccgatgataccaacggacttaccttcagcaattcttttttgggccaaagcagccaccttggctaactcgttgtatcatcactgg

SEQ ID NO: 185 - DNA, 24 bp, artificial sequence
  primer
ctaggatgagtagcagcacgttcc

SEQ ID NO: 186 - DNA, 26 bp, artificial sequence
  primer
ccaattccgtgatgtctctttgttgc

SEQ ID NO: 187 - DNA, 20 bp, artificial sequence
  primer
gtgaacgagttcacaaccgc

SEQ ID NO: 188 - DNA, 22 bp, artificial sequence
  primer
gttcgttccagaattatcacgc

SEQ ID NO: 189 - DNA, 55 bp, artificial sequence
  primer
agtaatacatattcaaatctagagctgaggatgaatcattctgctgaatgcacct

SEQ ID NO: 190 - DNA, 55 bp, artificial sequence
  primer
atcataagaaattcgcttactcttaattaattaactttctacggaacggatggcg

SEQ ID NO: 191 - DNA, 20 bp, artificial sequence
  primer
cgtgttagtcacatcaggac

SEQ ID NO: 192 - DNA, 22 bp, artificial sequence
  primer
catcgactgcattacgcaactc

SEQ ID NO: 193 - DNA, 19 bp, artificial sequence
  primer
gaaaacgtggcatcctctc

SEQ ID NO: 194 - DNA, 20 bp, artificial sequence
  primer
gcatcgagattatcgggatg

SEQ ID NO: 195 - DNA, 55 bp, artificial sequence
  primer
agtaatacatattcaaatctagagctgaggatgaaaaaagtcgcacttgttaccg

SEQ ID NO: 196 - DNA, 55 bp, artificial sequence
  primer
cgtgacataactaattacatgattaattaattagttaaacaccatcccgccgtcg

SEQ ID NO: 197 - DNA, 30 bp, artificial sequence
  primer
ggaattcacacatgaaagctctggtttatc

SEQ ID NO: 198 - DNA, 28 bp, artificial sequence
  primer
gcgtccagggcgtcaaagatcaggcagc

SEQ ID NO: 199 - DNA, 55 bp, artificial sequence
  primer
aaacaaacacacatattacaatagctgaggatgaaagctctggtttatcacggtg

SEQ ID NO: 200 - DNA, 55 bp, artificial sequence
  primer
atcataagaaattcgcttactcttaattaatcaggcagcgcctgcgttcgagagg

SEQ ID NO: 201 - DNA, 28 bp, artificial sequence
  primer
ggatccgcatgcttgcatttagtcgtgc

SEQ ID NO: 202 - DNA, 20 bp, artificial sequence
  primer
gggatgcggacgtattcggc

SEQ ID NO: 203 - DNA, 270 bp, Saccharomyces cerevisiae
gacctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaa

SEQ ID NO: 204 - DNA, 1020 bp, Lactococcus lactis
atggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcag

SEQ ID NO: 205 - protein, 340 aa, Lactococcus lactis
MAVTMYYEDDVEVSALAGKQIAVIGYGSQGHAHAQNLRDSGHNVIIGVRHGKSFDKAKEDGFETFEVGEAVAKADVIMVLAPDELQQSIYEEDIKPNLKAGSALGFAHGFNIHFGYIKVPEDVDVFMVAPKAPGHLVRRTYTEGFGTPALFVSHQNASGHAREIAMDWAKGIGCARVGIIETTFKEETEEDLFGEQAVLCGGLTALVEAGFETLTEAGYAGELAYFEVLHEMKLIVDLMYEGGFTKMRQSISNTAEFGDYVTGPRIITDEVKKNMKLVLADIQSGKFAQDFVDDFKAGRPKLIAYREAAKNLEIEKIGAELRQAMPFTQSGDDDAFKIYQ

SEQ ID NO: 206 - DNA, 83 bp, artificial sequence
  primer
gagtcctaggagttatatttttttaccctaccagcaatataagtaaaaaataaaaatggcagttacaatgtattatgaagatg

SEQ ID NO: 207 - DNA, 45 bp, artificial sequence
  primer
gataggcctgcagggccttactgatagattttaaaggcatcgtca

SEQ ID NO: 208 - DNA, 6207 bp, artificial sequence
  constructed plasmid
gacgaaagggccttataacttacaaataacccctcgaaaacattgaaagaataacccccaagatctatattatagatcttgggggttatttgttttaatattaaagaaatgacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggagccacaatcgtcatgttacttgtctgacagactagatcattgcttagcgcaatggctggtcgcttattcatctgttcatgaccacggcttggattaaagttaacataaaatatatcaccttggcttaccattgaagttcattaccttctgactttccccaatcaagctcgtgatcccttttcccgtcatctttccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagtcaagtatatcccatgtagatacacaatgcaaatattcttactggagaaataacaccttaagtctagcaccacccgcacgcatagcggtgcttaaaccatcaagggtcaagcccttaggctctctcaaacagttatcctaatcgtgaataactgcgcttcttttgcagtataaagagagaactctttatcagacaatttaagctcaaccagcccttgcactaactattattagagttggttttagcagcaacccgaataatctgcgttaatagttagcctgtccgtatcatttcctagtcttccagccacgtctttagtcgcgttgatctcgacaaggtttagcatacctatgttgttaactgcaagcggggtcacgaacgacactcacgggaggttttactagctaagaacaggtttccagcctttagttgctttgatggttgctaaccattgaataacaaaaaaacggttgctatcaggtttctgttaagattcccgataacaaccgtttactttaagtatcaatggttgaaaaacttagcctacatgttataatagtaccaagttagatagcttgtattggtagtacttgctatcgaaaatcttatcaggttgtgctgataagtcgtgaatcctaactctgctaagttgagggttcttttttttgcgttcatttattaagttgagtacattataaccgtaatataagattaatacaacctttatcattttaacgtctcaaccagccgaataatccttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataagggcccgcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtctcgaggaccgagcgcagcgagtcagtgagcgaggaagcggaagagcgagggcggagttgttgacagccgagcaggccttaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgttttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcatcaaaatcgtctccctccgtttgaatatttgattgatcgtaaccagatgaagcactctttccactatccctacagtgttatggcttgaacaatcacgaaacaataatcggtacgggggtgaaaaagctaacggaaaagggagcggaaaagaatgatgtaagcgtgaaaaattttttatcttatcacttgaaattggaagggagattctttattataagaattgtggaattgtgagcggataacaattcccaattaaaggaggaaggatcggccgctaagtcgtattggcaccactactcacaccgtgaccgacgcgcccgccagtcaagtgttcaaaagttagcgtttattaagtgcgataagtataccacaaagggcttattgacgcccgccaaagggttttgcggacattgttaataattgtattaaaagcatgctcaatctaacacttattttgcacaaacatggtatactttaaccgtaaaaactaaattttcactacgagaggatgacttattttgtcaagcctcgagatatataggaggaatttttgtaatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaacgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaa

SEQ ID NO: 209 - DNA, 16405 bp, artificial sequence
  constructed plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaagcatctaaaacacaaccgttggaagcgttggaaaccaacttagcatacttggatagagtacctcttgtgtaacgaggtggaggtgcaacccaactttgtttacgttgagccatttccttatcagagactaataggtcaatcttgttattatcagcatcaatgataatctcatcgccgtctctgaccaacccgataggaccaccttcagcggcttcgggaacaatgtggccgattaagaacccgtgagaaccaccagagaatctaccatcagtcaacaatgcaacatctttacccaaaccgtaacccatcagagcagaggaaggctttagcatttcaggcatacctggtgcacctcttggaccttcatatctgataacaacaacggttttttcacccttcttgatttcacctctttccaaggcttcaataaaggcaccttcctcttcgaacacacgtgctctacccttgaagtaagtaccttccttaccggtaattttacccacagctccacctggtgccaatgaaccgtacagaatttgcaagtgaccgttggccttgattgggtgggagagtggcttaataatctcttgtccttcaggtaggcttggtgctttctttgcacgttctgccaaagtgtcaccggtaacagtcattgtgttaccgtgcaacatgttgttttcatatagatacttaatcacagattgggtaccaccaacgttaatcaaatcggccatgacgtatttaccagaaggtttgaagtcaccgatcaatggtgtagtatcactgattctttggaaatcatctggtgacaacttgacacccgcagagtgagcaacagccaccaaatgcaaaacagcattagtggacccaccggttgcaacgacataagtaatggcgttttcaaaagcctcttttgtgaggatatcacgaggtaaaatacccaattccattgtcttcttgatgtattcaccaatgttgtcacactcagctaacttctccttggaaacggctgggaaggaagaggagtttggaatggtcaaacctagcacttcagcggcagaagccattgtgttggcagtatacataccaccacaagaaccaggacctgggcatgcatgttccacaacatcttctctttcttcttcagtgaattgcttggaaatatattcaccgtaggattggaacgcagagacgatatcgatgtttttagagatcctgttaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaataaaaatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagtatataatttttcaggtaaaatttagtacgatagtaaaatacttctcgaactcgtcacatatacgtgtacataatgtctgaaccagctcaaaagaaacaaaaggttgctaacaactctctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattattggttttctggtctcaactttctgacttccttaccaaccttccagatttccatgtttctgatggtgtctaattccttttctagcttttctctgtagtcaggttgagagttgaattccaaagatctcttggtttcggtaccgttcttggtagattcgtacaagtcttggaaaacaggcttcaaagcattcttgaagattgggtaccagtccaaagcacctcttctggcggtggtggaacaagcatcgtacatgtaatccataccgtacttaccgatcaatgggtatagagattgggtagcttcttcgacggtttcgttgaaagcttcagatggggagtgaccgttttctctcaagacgtcgtattgagccaagaacataccgtggataccacccattaaacaacctctttcaccgtacaagtcagagttgacttctctttcgaaagtggtttggtaaacgtaaccggaaccaatggcaacggccaaagcttgggccttttcgtgagccttaccggtgacatcgttccagacggcgtaagaagagttaataccacgaccttccttgaacaaagatctgacagttctaccggaaccctttggagcaaccaagataacatctaagtcctttggtggttcaacgtgagtcaagtccttgaagactggggagaaaccgtgggagaagtacaaagtcttacccttggtcaacaatggcttgatagcaggccaggtttctgattgagcggcatcggacaacaagttcataacgtaactacctctcttgatagcatcttcaacagtgaacaagttcttgcctggaacccaaccgtcttcgatggcagccttccaagaagcaccatctttacggacaccaatgataacgttcaaaccgttgtctctcaagttcaaaccttgaccgtaaccttgggaaccgtaaccgatcaaagcaaaagtgtcgttcttgaagtagtccaacaacttttctcttggccagtcagctctttcgtagacggtttcaacagtaccaccgaagttgatttgcttcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatctatccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 210 - DNA, 90 bp, Artificial sequence
  Primer
gtattttggtagattcaattctctttccctttccttttccttcgctccccttccttatcagcattgcggattacgtattctaatgttcag

SEQ ID NO: 211 - DNA, 90 bp, Artificial sequence
  Primer
ttggttgggggaaaaagaggcaacaggaaagatcagagggggagggggggggagagtgtcaccttggctaactcgttgtatcatcactgg

SEQ ID NO: 212 - DNA, 4236 bp, artificial sequence
  plasmid construct
gatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 213 - DNA, 7523 bp, Artificial sequence
  plasmid construct
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 214 - DNA, 29 bp, Artificial sequence
  Primer
ctcgaaacaataagacgacgatggctctg

SEQ ID NO: 215 - DNA, 29 bp, Artificial sequence
  Primer
gtctagaccagaagttaagaaggctgtag

SEQ ID NO: 216 - DNA, 26 bp, Artificial sequence
  Primer
tagcacccaatagagcgccgactgtg

SEQ ID NO: 217 - DNA, 4519 bp, Artificial sequence
  Plasmid
caccttggctaactcgttgtatcatcactggataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatctgaacattagaatacgtaatccgcaatgcggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtac

SEQ ID NO: 218 - DNA, 86 bp, Artificial sequence
  Primer
aggataaaaaaagcttgtgaataaaaatctttcgctaaaaatcaatataagaaaatggtacaccttggctaactcgttgtatcatc

SEQ ID NO: 219 - DNA, 90 bp, Artificial sequence
  Primer
tgcatactttatgcgtttatgcgttttgcgccccttggaaaaaaattgattctcatcgtagcattgcggattacgtattctaatgttcag

SEQ ID NO: 220 - DNA, 13114 bp, artificial sequence
  constructed plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgccgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacatgtttaaactttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 221 - DNA, 11856 bp, Artificial sequence
  constructed plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

What is claimed is:

1. A recombinant yeast production host cell comprising:
   (a) a first genetic modification, which has the effect of reducing glucose repression, wherein the first genetic modification is a deletion in at least one endogenous gene encoding a hexokinase enzyme that has nuclear and cytoplasmic localization, wherein the deletion eliminates the activity of the hexokinase enzyme; and
   (b) a second genetic modification, wherein the second genetic modification is a deletion in at least one endogenous gene encoding a pyruvate decarboxylase enzyme, wherein the deletion eliminates pyruvate decarboxylase activity; and
   (c) a pyruvate utilizing biosynthetic pathway, wherein the pyruvate utilizing biosynthetic pathway is an isobutanol biosynthetic pathway comprising heterologous DNA molecules encoding polypeptides that catalyze the following substrate to product conversions:
      i) pyruvate to acetolactate;
      ii) acetolactate to 2,3-dihydroxyisovalerate;
      iii) 2,3-dihydroxyisovalerate to α-ketoisovalerate;
      iv) α-ketoisovalerate to isobutyraldehyde; and
      v) isobutyraldehyde to isobutanol;
   wherein the yeast production host cell produces isobutanol, and
   wherein growth of the recombinant yeast production host cell is improved at least 2-fold as compared to a recombinant yeast production host cell without the first genetic modification.

2. The yeast production host cell of claim 1 wherein the yeast is selected from the group consisting of Saccharomyces, Zygosaccharomyces, Schizosaccharomyces, Dekkera, Torulopsis, Brettanomyces, and Candida.

3. The yeast production host cell of claim 1 comprising increased NADH-dependent enzyme activity.

4. The yeast production host cell of claim 3 wherein the increased NADH-dependent enzyme activity is an activity of the expressed pyruvate-utilizing biosynthetic pathway.

5. The yeast production host cell of claim 3 wherein the increased NADH-dependent enzyme activity is engineered by overexpressing an endogenous gene encoding a NADH-dependent enzyme.

6. The yeast production host cell of claim 3 wherein the increased NADH-dependent enzyme activity is engineered by expressing a heterologous gene encoding a NADH-dependent enzyme.

7. A method for the production of isobutanol comprising growing the yeast cell of claim 1 under conditions wherein the isobutanol is produced and optionally recovering the isobutanol.

* * * * *